United States Patent 11,396,665 (CRISPR-CAS SYSTEM FOR A FILAMENTOUS FUNGAL HOST CELL) - sequence listing, part 21

SEQ ID NO: 2 - DNA, 32255159 bp, Penicillium chrysogenum Wisconsin 54-1255 (residues 8,063,793-10,079,740 of 32,255,159)
  misc_feature (378565)..(378664): n is a, c, g, or t
  misc_feature (535561)..(535760): n is a, c, g, or t
  misc_feature (536965)..(537064): n is a, c, g, or t
  misc_feature (728282)..(728381): n is a, c, g, or t
  misc_feature (842435)..(842534): n is a, c, g, or t
  misc_feature (1110867)..(1111066): n is a, c, g, or t
  misc_feature (1150895)..(1150994): n is a, c, g, or t
  misc_feature (1164934)..(1165033): n is a, c, g, or t
  misc_feature (1167749)..(1167848): n is a, c, g, or t
  misc_feature (1170638)..(1170737): n is a, c, g, or t
  misc_feature (1288997)..(1289096): n is a, c, g, or t
  misc_feature (1294583)..(1294682): n is a, c, g, or t
  misc_feature (1294986)..(1294986): n is a, c, g, or t
  misc_feature (1294992)..(1294992): n is a, c, g, or t
  misc_feature (1295080)..(1295081): n is a, c, g, or t
  misc_feature (1295987)..(1295987): n is a, c, g, or t
  misc_feature (1296086)..(1296086): n is a, c, g, or t
  misc_feature (1296147)..(1296147): n is a, c, g, or t
  misc_feature (1383147)..(1383246): n is a, c, g, or t
  misc_feature (1403020)..(1403219): n is a, c, g, or t
  misc_feature (1426209)..(1426308): n is a, c, g, or t
  misc_feature (1448407)..(1448506): n is a, c, g, or t
  misc_feature (1476403)..(1476602): n is a, c, g, or t
  misc_feature (1476836)..(1476836): n is a, c, g, or t
  misc_feature (1519208)..(1519307): n is a, c, g, or t
  misc_feature (1634339)..(1634438): n is a, c, g, or t
  misc_feature (1634861)..(1634861): n is a, c, g, or t
  misc_feature (1634868)..(1634869): n is a, c, g, or t
  misc_feature (1634910)..(1634910): n is a, c, g, or t
  misc_feature (1635005)..(1635005): n is a, c, g, or t
  misc_feature (1635115)..(1635115): n is a, c, g, or t
  misc_feature (1635221)..(1635221): n is a, c, g, or t
  misc_feature (1635450)..(1635450): n is a, c, g, or t
  misc_feature (1635492)..(1635492): n is a, c, g, or t
  misc_feature (1635705)..(1635705): n is a, c, g, or t
  misc_feature (1635711)..(1635711): n is a, c, g, or t
  misc_feature (1635842)..(1635842): n is a, c, g, or t
  misc_feature (1636181)..(1636181): n is a, c, g, or t
  misc_feature (1636311)..(1636311): n is a, c, g, or t
  misc_feature (1636475)..(1636475): n is a, c, g, or t
  misc_feature (1636784)..(1636784): n is a, c, g, or t
  misc_feature (1636963)..(1636963): n is a, c, g, or t
  misc_feature (1636996)..(1636996): n is a, c, g, or t
  misc_feature (1637057)..(1637057): n is a, c, g, or t
  misc_feature (1637342)..(1637342): n is a, c, g, or t
  misc_feature (1637589)..(1637589): n is a, c, g, or t
  misc_feature (1637685)..(1637685): n is a, c, g, or t
  misc_feature (1637781)..(1637781): n is a, c, g, or t
  misc_feature (1638019)..(1638019): n is a, c, g, or t
  misc_feature (1639194)..(1639293): n is a, c, g, or t
  misc_feature (1639409)..(1639409): n is a, c, g, or t
  misc_feature (1639455)..(1639455): n is a, c, g, or t
  misc_feature (1639543)..(1639543): n is a, c, g, or t
  misc_feature (1639685)..(1639685): n is a, c, g, or t
  misc_feature (1639779)..(1639779): n is a, c, g, or t
  misc_feature (1678056)..(1678056): n is a, c, g, or t
  misc_feature (1678130)..(1678130): n is a, c, g, or t
  misc_feature (1678253)..(1678254): n is a, c, g, or t
  misc_feature (1678421)..(1678421): n is a, c, g, or t
  misc_feature (1678520)..(1678520): n is a, c, g, or t
  misc_feature (1679732)..(1679732): n is a, c, g, or t
  misc_feature (1680021)..(1680021): n is a, c, g, or t
  misc_feature (1680178)..(1680178): n is a, c, g, or t
  misc_feature (1680221)..(1680221): n is a, c, g, or t
  misc_feature (1680328)..(1680328): n is a, c, g, or t
  misc_feature (1680357)..(1680357): n is a, c, g, or t
  misc_feature (1680383)..(1680383): n is a, c, g, or t
  misc_feature (1680389)..(1680389): n is a, c, g, or t
  misc_feature (1680595)..(1680595): n is a, c, g, or t
  misc_feature (1698170)..(1698170): n is a, c, g, or t
  misc_feature (1698470)..(1698470): n is a, c, g, or t
  misc_feature (1698656)..(1698657): n is a, c, g, or t
  misc_feature (1698736)..(1698736): n is a, c, g, or t
  misc_feature (1698749)..(1698749): n is a, c, g, or t
  misc_feature (1707919)..(1708118): n is a, c, g, or t
  misc_feature (1718467)..(1718566): n is a, c, g, or t
  misc_feature (1718592)..(1718592): n is a, c, g, or t
  misc_feature (1724374)..(1724473): n is a, c, g, or t
  misc_feature (1743679)..(1743679): n is a, c, g, or t
  misc_feature (1743689)..(1743689): n is a, c, g, or t
  misc_feature (1743703)..(1743703): n is a, c, g, or t
  misc_feature (1743850)..(1743850): n is a, c, g, or t
  misc_feature (1743856)..(1743856): n is a, c, g, or t
  misc_feature (1743910)..(1743910): n is a, c, g, or t
  misc_feature (1744470)..(1744470): n is a, c, g, or t
  misc_feature (1744769)..(1744769): n is a, c, g, or t
  misc_feature (1745108)..(1745108): n is a, c, g, or t
  misc_feature (1745118)..(1745118): n is a, c, g, or t
  misc_feature (1745472)..(1745472): n is a, c, g, or t
  misc_feature (1745580)..(1745580): n is a, c, g, or t
  misc_feature (1745782)..(1745782): n is a, c, g, or t
  misc_feature (1747968)..(1748167): n is a, c, g, or t
  misc_feature (1752521)..(1752521): n is a, c, g, or t
  misc_feature (1752844)..(1752844): n is a, c, g, or t
  misc_feature (1752878)..(1752878): n is a, c, g, or t
  misc_feature (1752991)..(1752991): n is a, c, g, or t
  misc_feature (1753007)..(1753007): n is a, c, g, or t
  misc_feature (1753021)..(1753021): n is a, c, g, or t
  misc_feature (1753061)..(1753062): n is a, c, g, or t
  misc_feature (1753092)..(1753092): n is a, c, g, or t
  misc_feature (1753106)..(1753106): n is a, c, g, or t
  misc_feature (1753285)..(1753285): n is a, c, g, or t
  misc_feature (1753343)..(1753343): n is a, c, g, or t
  misc_feature (1753434)..(1753434): n is a, c, g, or t
  misc_feature (1753458)..(1753458): n is a, c, g, or t
  misc_feature (1753468)..(1753469): n is a, c, g, or t
  misc_feature (1753471)..(1753471): n is a, c, g, or t
  misc_feature (1753473)..(1753473): n is a, c, g, or t
  misc_feature (1753475)..(1753475): n is a, c, g, or t
  misc_feature (1753478)..(1753481): n is a, c, g, or t
  misc_feature (1753483)..(1753483): n is a, c, g, or t
  misc_feature (1753485)..(1753485): n is a, c, g, or t
  misc_feature (1753487)..(1753489): n is a, c, g, or t
  misc_feature (1753491)..(1753494): n is a, c, g, or t
  misc_feature (1753498)..(1753498): n is a, c, g, or t
  misc_feature (1753502)..(1753502): n is a, c, g, or t
  misc_feature (1753507)..(1753509): n is a, c, g, or t
  misc_feature (1753513)..(1753513): n is a, c, g, or t
  misc_feature (1753521)..(1753521): n is a, c, g, or t
  misc_feature (1753524)..(1753525): n is a, c, g, or t
  misc_feature (1753527)..(1753528): n is a, c, g, or t
  misc_feature (1753530)..(1753530): n is a, c, g, or t
  misc_feature (1753533)..(1753533): n is a, c, g, or t
  misc_feature (1753535)..(1753536): n is a, c, g, or t
  misc_feature (1753538)..(1753539): n is a, c, g, or t
  misc_feature (1753541)..(1753541): n is a, c, g, or t
  misc_feature (1753543)..(1753544): n is a, c, g, or t
  misc_feature (1753548)..(1753549): n is a, c, g, or t
  misc_feature (1753551)..(1753551): n is a, c, g, or t
  misc_feature (1753557)..(1753559): n is a, c, g, or t
  misc_feature (1753566)..(1753566): n is a, c, g, or t
  misc_feature (1753569)..(1753569): n is a, c, g, or t
  misc_feature (1753574)..(1753574): n is a, c, g, or t
  misc_feature (1753582)..(1753582): n is a, c, g, or t
  misc_feature (1753685)..(1753685): n is a, c, g, or t
  misc_feature (1753705)..(1753705): n is a, c, g, or t
  misc_feature (1753794)..(1753794): n is a, c, g, or t
  misc_feature (1753854)..(1753854): n is a, c, g, or t
  misc_feature (1754183)..(1754183): n is a, c, g, or t
  misc_feature (1754466)..(1754466): n is a, c, g, or t
  misc_feature (1754480)..(1754480): n is a, c, g, or t
  misc_feature (1754702)..(1754702): n is a, c, g, or t
  misc_feature (1754869)..(1754869): n is a, c, g, or t
  misc_feature (1754898)..(1754898): n is a, c, g, or t
  misc_feature (1755497)..(1755497): n is a, c, g, or t
  misc_feature (1755575)..(1755575): n is a, c, g, or t
  misc_feature (1763296)..(1763296): n is a, c, g, or t
  misc_feature (1763710)..(1763710): n is a, c, g, or t
  misc_feature (1763926)..(1763926): n is a, c, g, or t
  misc_feature (1763953)..(1763953): n is a, c, g, or t
  misc_feature (1764043)..(1764043): n is a, c, g, or t
  misc_feature (1804005)..(1804104): n is a, c, g, or t
  misc_feature (1814513)..(1814612): n is a, c, g, or t
  misc_feature (1818918)..(1818918): n is a, c, g, or t
  misc_feature (1818975)..(1818975): n is a, c, g, or t
  misc_feature (1824975)..(1824975): n is a, c, g, or t
  misc_feature (1824990)..(1824990): n is a, c, g, or t
  misc_feature (1825019)..(1825019): n is a, c, g, or t
  misc_feature (1825048)..(1825048): n is a, c, g, or t
  misc_feature (1825053)..(1825053): n is a, c, g, or t
  misc_feature (1825113)..(1825113): n is a, c, g, or t
  misc_feature (1825194)..(1825194): n is a, c, g, or t
  misc_feature (1825216)..(1825216): n is a, c, g, or t
  misc_feature (1825221)..(1825221): n is a, c, g, or t
  misc_feature (1825223)..(1825225): n is a, c, g, or t
  misc_feature (1825228)..(1825230): n is a, c, g, or t
  misc_feature (1825232)..(1825232): n is a, c, g, or t
  misc_feature (1825234)..(1825236): n is a, c, g, or t
  misc_feature (1825239)..(1825239): n is a, c, g, or t
  misc_feature (1825242)..(1825242): n is a, c, g, or t
  misc_feature (1825244)..(1825246): n is a, c, g, or t
  misc_feature (1825248)..(1825250): n is a, c, g, or t
  misc_feature (1825252)..(1825252): n is a, c, g, or t
  misc_feature (1825256)..(1825256): n is a, c, g, or t
  misc_feature (1825258)..(1825258): n is a, c, g, or t
  misc_feature (1825260)..(1825260): n is a, c, g, or t
  misc_feature (1825262)..(1825262): n is a, c, g, or t
  misc_feature (1825264)..(1825265): n is a, c, g, or t
  misc_feature (1825269)..(1825269): n is a, c, g, or t
  misc_feature (1825271)..(1825273): n is a, c, g, or t
  misc_feature (1825275)..(1825275): n is a, c, g, or t
  misc_feature (1825278)..(1825279): n is a, c, g, or t
  misc_feature (1825281)..(1825281): n is a, c, g, or t
  misc_feature (1825285)..(1825286): n is a, c, g, or t
  misc_feature (1825289)..(1825295): n is a, c, g, or t
  misc_feature (1825298)..(1825302): n is a, c, g, or t
  misc_feature (1825306)..(1825307): n is a, c, g, or t
  misc_feature (1825309)..(1825311): n is a, c, g, or t
  misc_feature (1825313)..(1825314): n is a, c, g, or t
  misc_feature (1825317)..(1825319): n is a, c, g, or t
  misc_feature (1825321)..(1825321): n is a, c, g, or t
  misc_feature (1825323)..(1825323): n is a, c, g, or t
  misc_feature (1825325)..(1825325): n is a, c, g, or t
  misc_feature (1825327)..(1825327): n is a, c, g, or t
  misc_feature (1825331)..(1825331): n is a, c, g, or t
  misc_feature (1825333)..(1825333): n is a, c, g, or t
  misc_feature (1825335)..(1825337): n is a, c, g, or t
  misc_feature (1825339)..(1825343): n is a, c, g, or t
  misc_feature (1825347)..(1825348): n is a, c, g, or t
  misc_feature (1825350)..(1825351): n is a, c, g, or t
  misc_feature (1825353)..(1825357): n is a, c, g, or t
  misc_feature (1825359)..(1825359): n is a, c, g, or t
  misc_feature (1825361)..(1825362): n is a, c, g, or t
  misc_feature (1825364)..(1825364): n is a, c, g, or t
  misc_feature (1825367)..(1825368): n is a, c, g, or t
  misc_feature (1825370)..(1825370): n is a, c, g, or t
  misc_feature (1825373)..(1825375): n is a, c, g, or t
  misc_feature (1825379)..(1825379): n is a, c, g, or t
  misc_feature (1825381)..(1825381): n is a, c, g, or t
  misc_feature (1825383)..(1825383): n is a, c, g, or t
  misc_feature (1825385)..(1825387): n is a, c, g, or t
  misc_feature (1825389)..(1825389): n is a, c, g, or t
  misc_feature (1825391)..(1825392): n is a, c, g, or t
  misc_feature (1825395)..(1825395): n is a, c, g, or t
  misc_feature (1825399)..(1825399): n is a, c, g, or t
  misc_feature (1825401)..(1825401): n is a, c, g, or t
  misc_feature (1825403)..(1825403): n is a, c, g, or t
  misc_feature (1825406)..(1825406): n is a, c, g, or t
  misc_feature (1825408)..(1825409): n is a, c, g, or t
  misc_feature (1825411)..(1825411): n is a, c, g, or t
  misc_feature (1825414)..(1825415): n is a, c, g, or t
  misc_feature (1825420)..(1825420): n is a, c, g, or t
  misc_feature (1825423)..(1825423): n is a, c, g, or t
  misc_feature (1825425)..(1825426): n is a, c, g, or t
  misc_feature (1825432)..(1825432): n is a, c, g, or t
  misc_feature (1825435)..(1825435): n is a, c, g, or t
  misc_feature (1825438)..(1825439): n is a, c, g, or t
  misc_feature (1825441)..(1825442): n is a, c, g, or t
  misc_feature (1825445)..(1825446): n is a, c, g, or t
  misc_feature (1825448)..(1825448): n is a, c, g, or t
  misc_feature (1825450)..(1825453): n is a, c, g, or t
  misc_feature (1825457)..(1825457): n is a, c, g, or t
  misc_feature (1825459)..(1825459): n is a, c, g, or t
  misc_feature (1825466)..(1825466): n is a, c, g, or t
  misc_feature (1825470)..(1825474): n is a, c, g, or t
  misc_feature (1825476)..(1825477): n is a, c, g, or t
  misc_feature (1825479)..(1825479): n is a, c, g, or t
  misc_feature (1825483)..(1825485): n is a, c, g, or t
  misc_feature (1825489)..(1825489): n is a, c, g, or t
  misc_feature (1825492)..(1825492): n is a, c, g, or t
  misc_feature (1825494)..(1825498): n is a, c, g, or t
  misc_feature (1825500)..(1825500): n is a, c, g, or t
  misc_feature (1825502)..(1825502): n is a, c, g, or t
  misc_feature (1825505)..(1825506): n is a, c, g, or t
  misc_feature (1825510)..(1825510): n is a, c, g, or t
  misc_feature (1825514)..(1825514): n is a, c, g, or t
  misc_feature (1825520)..(1825521): n is a, c, g, or t
  misc_feature (1825529)..(1825530): n is a, c, g, or t
  misc_feature (1825555)..(1825555): n is a, c, g, or t
  misc_feature (1825674)..(1825674): n is a, c, g, or t
  misc_feature (1825725)..(1825725): n is a, c, g, or t
  misc_feature (1825792)..(1825792): n is a, c, g, or t
  misc_feature (1825831)..(1825831): n is a, c, g, or t
  misc_feature (1825894)..(1825894): n is a, c, g, or t
  misc_feature (1825907)..(1825907): n is a, c, g, or t
  misc_feature (1826143)..(1826143): n is a, c, g, or t
  misc_feature (1826206)..(1826206): n is a, c, g, or t
  misc_feature (1828487)..(1828487): n is a, c, g, or t
  misc_feature (1828624)..(1828624): n is a, c, g, or t
  misc_feature (1828728)..(1828728): n is a, c, g, or t
  misc_feature (1828773)..(1828773): n is a, c, g, or t
  misc_feature (1912009)..(1912009): n is a, c, g, or t
  misc_feature (1912846)..(1912846): n is a, c, g, or t
  misc_feature (1912866)..(1912866): n is a, c, g, or t
  misc_feature (1913054)..(1913054): n is a, c, g, or t
  misc_feature (2214087)..(2214186): n is a, c, g, or t
  misc_feature (2214319)..(2214321): n is a, c, g, or t
  misc_feature (2391730)..(2391730): n is a, c, g, or t
  misc_feature (2533052)..(2533151): n is a, c, g, or t
  misc_feature (2533175)..(2533176): n is a, c, g, or t
  misc_feature (3130685)..(3130784): n is a, c, g, or t
  misc_feature (3181891)..(3181891): n is a, c, g, or t
  misc_feature (3398907)..(3398907): n is a, c, g, or t
  misc_feature (3431881)..(3431881): n is a, c, g, or t
  misc_feature (3431886)..(3431985): n is a, c, g, or t
  misc_feature (3571328)..(3571427): n is a, c, g, or t
  misc_feature (3927925)..(3928024): n is a, c, g, or t
  misc_feature (4555177)..(4555276): n is a, c, g, or t
  misc_feature (4555538)..(4555538): n is a, c, g, or t
  misc_feature (4555540)..(4555543): n is a, c, g, or t
  misc_feature (4625103)..(4625103): n is a, c, g, or t
  misc_feature (4663296)..(4663296): n is a, c, g, or t
  misc_feature (4759544)..(4759643): n is a, c, g, or t
  misc_feature (4832703)..(4832802): n is a, c, g, or t
  misc_feature (4924584)..(4924683): n is a, c, g, or t
  misc_feature (5083872)..(5083971): n is a, c, g, or t
  misc_feature (5109434)..(5109434): n is a, c, g, or t
  misc_feature (5109679)..(5109778): n is a, c, g, or t
  misc_feature (5116413)..(5116512): n is a, c, g, or t
  misc_feature (5118992)..(5119091): n is a, c, g, or t
  misc_feature (5135806)..(5135905): n is a, c, g, or t
  misc_feature (5139465)..(5139564): n is a, c, g, or t
  misc_feature (5166943)..(5167042): n is a, c, g, or t
  misc_feature (5168994)..(5168994): n is a, c, g, or t
  misc_feature (5171046)..(5171145): n is a, c, g, or t
  misc_feature (5179991)..(5180090): n is a, c, g, or t
  misc_feature (5218836)..(5218935): n is a, c, g, or t
  misc_feature (5219206)..(5219206): n is a, c, g, or t
  misc_feature (5398483)..(5398483): n is a, c, g, or t
  misc_feature (5460523)..(5460622): n is a, c, g, or t
  misc_feature (5463386)..(5463485): n is a, c, g, or t
  misc_feature (5466518)..(5466520): n is a, c, g, or t
  misc_feature (5466525)..(5466527): n is a, c, g, or t
  misc_feature (5466529)..(5466529): n is a, c, g, or t
  misc_feature (5466531)..(5466531): n is a, c, g, or t
  misc_feature (5468727)..(5468926): n is a, c, g, or t
  misc_feature (5789749)..(5789848): n is a, c, g, or t
  misc_feature (6310176)..(6310275): n is a, c, g, or t
  misc_feature (6797195)..(6797195): n is a, c, g, or t
  misc_feature (6797205)..(6797205): n is a, c, g, or t
  misc_feature (6852730)..(6852829): n is a, c, g, or t
  misc_feature (6941921)..(6942020): n is a, c, g, or t
  misc_feature (7922997)..(7923096): n is a, c, g, or t
  misc_feature (7941620)..(7941719): n is a, c, g, or t
  misc_feature (8258182)..(8258281): n is a, c, g, or t
  misc_feature (8479375)..(8479474): n is a, c, g, or t
  misc_feature (8514168)..(8514267): n is a, c, g, or t
  misc_feature (11166382)..(11166481): n is a, c, g, or t
  misc_feature (11275284)..(11275383): n is a, c, g, or t
  misc_feature (11433451)..(11433550): n is a, c, g, or t
  misc_feature (11739923)..(11740022): n is a, c, g, or t
  misc_feature (11859261)..(11859460): n is a, c, g, or t
  misc_feature (11860510)..(11860510): n is a, c, g, or t
  misc_feature (11860556)..(11860556): n is a, c, g, or t
  misc_feature (11860562)..(11860562): n is a, c, g, or t
  misc_feature (11861061)..(11861061): n is a, c, g, or t
  misc_feature (11861318)..(11861318): n is a, c, g, or t
  misc_feature (11861550)..(11861550): n is a, c, g, or t
  misc_feature (11861603)..(11861603): n is a, c, g, or t
  misc_feature (11861776)..(11861776): n is a, c, g, or t
  misc_feature (11861793)..(11861793): n is a, c, g, or t
  misc_feature (11861860)..(11861860): n is a, c, g, or t
  misc_feature (11861932)..(11861932): n is a, c, g, or t
  misc_feature (11861939)..(11861939): n is a, c, g, or t
  misc_feature (11861963)..(11861963): n is a, c, g, or t
  misc_feature (11862136)..(11862136): n is a, c, g, or t
  misc_feature (11862654)..(11862654): n is a, c, g, or t
  misc_feature (11862927)..(11862927): n is a, c, g, or t
  misc_feature (11863214)..(11863214): n is a, c, g, or t
  misc_feature (11863332)..(11863332): n is a, c, g, or t
  misc_feature (11863817)..(11863817): n is a, c, g, or t
  misc_feature (11863890)..(11863890): n is a, c, g, or t
  misc_feature (11863902)..(11863902): n is a, c, g, or t
  misc_feature (11864175)..(11864175): n is a, c, g, or t
  misc_feature (11864202)..(11864202): n is a, c, g, or t
  misc_feature (11864219)..(11864219): n is a, c, g, or t
  misc_feature (11864228)..(11864228): n is a, c, g, or t
  misc_feature (11864260)..(11864260): n is a, c, g, or t
  misc_feature (11864399)..(11864399): n is a, c, g, or t
  misc_feature (11864409)..(11864409): n is a, c, g, or t
  misc_feature (11865254)..(11865254): n is a, c, g, or t
  misc_feature (11865840)..(11865840): n is a, c, g, or t
  misc_feature (11866142)..(11866142): n is a, c, g, or t
  misc_feature (11866433)..(11866433): n is a, c, g, or t
  misc_feature (13014614)..(13014713): n is a, c, g, or t
  misc_feature (13359291)..(13359390): n is a, c, g, or t
  misc_feature (13578351)..(13578450): n is a, c, g, or t
  misc_feature (15440523)..(15440622): n is a, c, g, or t
  misc_feature (15514292)..(15514391): n is a, c, g, or t
  misc_feature (15633503)..(15633602): n is a, c, g, or t
  misc_feature (17444632)..(17444731): n is a, c, g, or t
  misc_feature (17570890)..(17570989): n is a, c, g, or t
  misc_feature (17949711)..(17949810): n is a, c, g, or t
  misc_feature (17990438)..(17990637): n is a, c, g, or t
  misc_feature (17997939)..(17997939): n is a, c, g, or t
  misc_feature (17998057)..(17998057): n is a, c, g, or t
  misc_feature (17998097)..(17998097): n is a, c, g, or t
  misc_feature (17998111)..(17998111): n is a, c, g, or t
  misc_feature (17998118)..(17998118): n is a, c, g, or t
  misc_feature (19644967)..(19645066): n is a, c, g, or t
  misc_feature (20236706)..(20236805): n is a, c, g, or t
  misc_feature (20598071)..(20598170): n is a, c, g, or t
  misc_feature (20781330)..(20781429): n is a, c, g, or t
  misc_feature (21894911)..(21895010): n is a, c, g, or t
  misc_feature (22052562)..(22052661): n is a, c, g, or t
  misc_feature (22153906)..(22154005): n is a, c, g, or t
  misc_feature (22161995)..(22162094): n is a, c, g, or t
  misc_feature (22175945)..(22176144): n is a, c, g, or t
  misc_feature (22179030)..(22179129): n is a, c, g, or t
  misc_feature (22222667)..(22222667): n is a, c, g, or t
  misc_feature (22222832)..(22222832): n is a, c, g, or t
  misc_feature (22222853)..(22222853): n is a, c, g, or t
  misc_feature (22275555)..(22275654): n is a, c, g, or t
  misc_feature (22311968)..(22311968): n is a, c, g, or t
  misc_feature (22363188)..(22363188): n is a, c, g, or t
  misc_feature (22363226)..(22363226): n is a, c, g, or t
  misc_feature (22363245)..(22363245): n is a, c, g, or t
  misc_feature (22363269)..(22363269): n is a, c, g, or t
  misc_feature (22363294)..(22363294): n is a, c, g, or t
  misc_feature (22363323)..(22363323): n is a, c, g, or t
  misc_feature (22363342)..(22363342): n is a, c, g, or t
  misc_feature (22363363)..(22363363): n is a, c, g, or t
  misc_feature (22363453)..(22363453): n is a, c, g, or t
  misc_feature (22363456)..(22363456): n is a, c, g, or t
  misc_feature (22363490)..(22363491): n is a, c, g, or t
  misc_feature (22363574)..(22363574): n is a, c, g, or t
  misc_feature (22364253)..(22364253): n is a, c, g, or t
  misc_feature (22364343)..(22364343): n is a, c, g, or t
  misc_feature (22364505)..(22364505): n is a, c, g, or t
  misc_feature (22364738)..(22364738): n is a, c, g, or t
  misc_feature (22364753)..(22364753): n is a, c, g, or t
  misc_feature (22364836)..(22364836): n is a, c, g, or t
  misc_feature (22365245)..(22365245): n is a, c, g, or t
  misc_feature (22432888)..(22432888): n is a, c, g, or t
  misc_feature (22433074)..(22433074): n is a, c, g, or t
  misc_feature (22496764)..(22496764): n is a, c, g, or t
  misc_feature (22497055)..(22497055): n is a, c, g, or t
  misc_feature (22497059)..(22497059): n is a, c, g, or t
  misc_feature (22497101)..(22497101): n is a, c, g, or t
  misc_feature (22497192)..(22497192): n is a, c, g, or t
  misc_feature (22497293)..(22497293): n is a, c, g, or t
  misc_feature (22497392)..(22497392): n is a, c, g, or t
  misc_feature (22497502)..(22497502): n is a, c, g, or t
  misc_feature (22508590)..(22508590): n is a, c, g, or t
  misc_feature (22588253)..(22588352): n is a, c, g, or t
  misc_feature (22597862)..(22597862): n is a, c, g, or t
  misc_feature (22598026)..(22598026): n is a, c, g, or t
  misc_feature (22600773)..(22600972): n is a, c, g, or t
  misc_feature (22613286)..(22613286): n is a, c, g, or t
  misc_feature (22613300)..(22613300): n is a, c, g, or t
  misc_feature (22613396)..(22613396): n is a, c, g, or t
  misc_feature (22613469)..(22613469): n is a, c, g, or t
  misc_feature (22613694)..(22613694): n is a, c, g, or t
  misc_feature (22613830)..(22613830): n is a, c, g, or t
  misc_feature (22614028)..(22614028): n is a, c, g, or t
  misc_feature (22614683)..(22614683): n is a, c, g, or t
  misc_feature (22614716)..(22614716): n is a, c, g, or t
  misc_feature (22614895)..(22614895): n is a, c, g, or t
  misc_feature (22615255)..(22615255): n is a, c, g, or t
  misc_feature (22615368)..(22615368): n is a, c, g, or t
  misc_feature (22615644)..(22615644): n is a, c, g, or t
  misc_feature (22615753)..(22615753): n is a, c, g, or t
  misc_feature (22615756)..(22615756): n is a, c, g, or t
  misc_feature (22615837)..(22615837): n is a, c, g, or t
  misc_feature (22615968)..(22615968): n is a, c, g, or t
  misc_feature (22615974)..(22615974): n is a, c, g, or t
  misc_feature (22616187)..(22616187): n is a, c, g, or t
  misc_feature (22616229)..(22616229): n is a, c, g, or t
  misc_feature (22616564)..(22616564): n is a, c, g, or t
  misc_feature (22621942)..(22621942): n is a, c, g, or t
  misc_feature (22622047)..(22622047): n is a, c, g, or t
  misc_feature (22622219)..(22622219): n is a, c, g, or t
  misc_feature (22622305)..(22622305): n is a, c, g, or t
  misc_feature (22622312)..(22622312): n is a, c, g, or t
  misc_feature (22622342)..(22622342): n is a, c, g, or t
  misc_feature (22622471)..(22622471): n is a, c, g, or t
  misc_feature (22703009)..(22703108): n is a, c, g, or t
  misc_feature (22770099)..(22770198): n is a, c, g, or t
  misc_feature (22771325)..(22771524): n is a, c, g, or t
  misc_feature (22838292)..(22838292): n is a, c, g, or t
  misc_feature (22838324)..(22838324): n is a, c, g, or t
  misc_feature (22838351)..(22838351): n is a, c, g, or t
  misc_feature (22838373)..(22838373): n is a, c, g, or t
  misc_feature (22838391)..(22838391): n is a, c, g, or t
  misc_feature (22839537)..(22839736): n is a, c, g, or t
  misc_feature (22841901)..(22842000): n is a, c, g, or t
  misc_feature (22896688)..(22896787): n is a, c, g, or t
  misc_feature (22902688)..(22902787): n is a, c, g, or t
  misc_feature (22939457)..(22939556): n is a, c, g, or t
  misc_feature (22986860)..(22986959): n is a, c, g, or t
  misc_feature (23183622)..(23183721): n is a, c, g, or t
  misc_feature (23711569)..(23711668): n is a, c, g, or t
  misc_feature (23765430)..(23765529): n is a, c, g, or t
  misc_feature (25022283)..(25022382): n is a, c, g, or t
  misc_feature (25024124)..(25024223): n is a, c, g, or t
  misc_feature (25645952)..(25646051): n is a, c, g, or t
  misc_feature (26076323)..(26076422): n is a, c, g, or t
  misc_feature (26708564)..(26708663): n is a, c, g, or t
  misc_feature (27097140)..(27097239): n is a, c, g, or t
  misc_feature (27221003)..(27221102): n is a, c, g, or t
  misc_feature (28102101)..(28102200): n is a, c, g, or t
  misc_feature (28483527)..(28483527): n is a, c, g, or t
  misc_feature (28483610)..(28483610): n is a, c, g, or t
  misc_feature (28483848)..(28483848): n is a, c, g, or t
  misc_feature (28484503)..(28484503): n is a, c, g, or t
  misc_feature (28486065)..(28486065): n is a, c, g, or t
  misc_feature (28487283)..(28487283): n is a, c, g, or t
  misc_feature (28490490)..(28490689): n is a, c, g, or t
  misc_feature (28496472)..(28496571): n is a, c, g, or t
  misc_feature (29192462)..(29192561): n is a, c, g, or t
  misc_feature (30363702)..(30363801): n is a, c, g, or t
  misc_feature (30471417)..(30471516): n is a, c, g, or t
  misc_feature (30481809)..(30481908): n is a, c, g, or t
  misc_feature (30528021)..(30528120): n is a, c, g, or t
  misc_feature (30859689)..(30859788): n is a, c, g, or t
  misc_feature (31218350)..(31218449): n is a, c, g, or t
  misc_feature (32158827)..(32158926): n is a, c, g, or t
atgacacgaagccaactccgattccaattccaatttgtacggatagcgacaatgccgttgccattctcaaaaaggattcttacaacaaggggaccaagtggttagatgtcaaataccaatttgtgaaacatgctatgaagacgaagcagatcgacatccagctcatcgacagcaaggaaaacccggcagatgcattaacaaaagcactgccaaaggtcgacttcgaaaggattcgaaaactgctggtgagcaagaaggattgatgatttttactgcgtctttctctatactttttactgcaatttttactatgcgaaccagattgattttggcttttgatgctcagtctgggggggtgtgttgacatgcatggtatggtatgtctttatgcctttgtccctttgtgcagactgagcctttgctatgtcagcttgatatgtcagtttgtcagtttgccattcctttgttagtacaggcttcatatacagcctgtttttccatagattcatagtacgcatcttcttcccgattttccctccatgctagtttatctcactagcagtcctccttcgtagcctcatcaagttctttataggaaaagagtgcatttgaattcagaatactaagtatagagagggaaagagaaagaggaaaggatcgttagctataggatcctttctatatgcgcagatctcgagtcggagacatccagcagaaaaccctgtcgacttcaaccctgagccctgatctgtcctgtcacatgtctaaaacaaacatcatcacgtgactgtgcagtcgaacatccagataacatccagatcgtcacaactactaccttaactccccgatatatctcgatactaattagatcccggcgagttaaacgttataatactaatacggttagatggctacgctagcgtataacctctaggtccttaattcgtatatagatagagactagttaatagatatccggggtgttaaggtgctaataggggtagaaatccgctagggagaggctttatcccctctcctatacctagtaaatagtatacccataaggtaaacctctacctactatagtgcctatataagtaggtagaaatactatattatctaatctataatactttatatagatctctatagcgcggttaattacttcctaggaaatgatatatttaataccctaaaaaatagggataggcgttaattgaaactaagtttttttatctttaataccctagagagtatttatatttaactatataaccgtcgtaccgaagatagatactagggttaagaaatcataccttactatctatatatttatctttaacctatagtgtacacccttaacgcgggaggtagtggtttcgttaaggtagaagtagtgctttatataataccggagaaaggcctttaagtagctaaaaacctcggaaatccactcgctttttaagtatctagatataaactattagtttattagaaataagggttaaaataagggttaaaataggggttaaagtataggggtaaaatatagggttttacttaataaatatatcaaaagggagacactgctagcacaccgaggtttactccggacacaccactagtaccatttcgggatagtcactcttagcagtcaggtttcaatacgagtgccatttattatagtattgccttagtaaaaaacacagcccccgaacatctccagccacagagtacatatacggtcggtctgatctttcccccccttttatctgattataaagctccccgtaaatcacgtgatctggatagggcttgtttgctagggtttgccgagtccccgcacaaatattctggtctcctatagtaaaagctgcactttcacctgcacttttacaaccccttttcattagtttgaacactatttttatcagtttaaaaatgcactttgattttgactttcatttattttaaatacaggcaaaaatgcaggcaaaaatgcagacaaaaatgcagacaaaaatgaagcttttactataggaaaccagaatgcaaattaacattgatatacagatttttcatttgtatacggactcggttaaccctagcaaacaagccctatccagatcacgtgatttacggggtgctttataatcagataaaaaggggtgggggcgcgggtaaagatcagaccgaccgcagaagtactctgtggctggagatattcgggggctatgttttttactaaggtaataccataataaatggcactcgtattaaaaattgactactaagagtgactatcccgaaatggtactagtggtatatccggagtaaatatcggtgtgctagcagtatctcccatatcaaaaatagggttatagtagttatcctagaatttatcctatatatcgtctatatcgttatatatagagactagccgattccactttacttttataatatcctattatttattaatctcggcctagaaggctttacccttcggtattctaatatagcgcttaacgtagttatagatagctagctttatatatttctcgacgttattaaggatatactagaggtagattatagtattcgtactcggaaaaacctagtaaaaatagtaattagtacgatactaactaactagtaggaatagggatagataaatcacctagttaagcgctttaataagtgcttactctttatccgtaataatagttagtagactaaggtaaggctactactctatagtaactagcgtactagtaggatctaaattagggggtaaggtattagggggtaaggtaggcttaattactaatccttctacaataggattagatcctagatagaaggattagtatacctcctttaagtagtaaagtacactagtgtaaacttccgcctactccctatttataaaggtaatactagtattaaagcttttattagtaatagataccctaataatattaaagagaggtatatagaatagattagacttatatatatatatagtctatctataggatatatagataggcccgaagtaatactaagctacttttatatattaaaaatagtatactaagtctcttagatttatcgatagtataccgtataaactagctactatcctatagtagttaattaagtaatacctatatcgtagttatagagctaagcctctctttattctagcgctactttatattctctagatcctttactataatatagcttatagctttatttatatagtaggagtcgaggataaagcggtttagaaggaatttctctactatattaattatatctaaccggctctatcttatctcccgctagcgatacgtagtgtacgctaatagaggtacacctaggtagttataactagaataagttatagttatagtataggaaccggtaataggattataatatagtaaacctagatataagaattgctttaactagataattaataaatatagagtagcgatatagcttcttacctaaaaaggggcaccctatcctatagtatatagtcttacgtatcttcttaatacgccgatccttatattttaagctccgttaacactaaaattgtatagtaaggacgataccctacgtattcttatataaggatttctttaacactatatacccctatattactacctagttattaatagagtcgatagcttcttatatatccctaaataacgtatttactagaggtagaagtatagactaggggcctatatactcgctcggaggattaggattaggggtatactcgctcggaggattaggggtatactctattaaagatatcttaaatagataaattatagtcaaaaatgtagttaaaaaagaagttaggaatatagtcaaaaatatagtcaaaaaagaagttagaaatatagtcaaaaatacagtcgtaaataaagctattcacaacggggatagatagatttactaatataattattactatagggtactctaataaccctagtaaattagccctatacagattatatgatttaatagaggtatagattagattaatttaattaatttcattaaagtactatatagctaaggtagctagggtactatattttttactatagtagtactataataaatagcactagtattaaaaattggaagctaagagagacaaatcctaattaggactaacccctatagttgtagggaaaccgctataatagtagggtcttcccgctactaatagagtacttactatagagccgttataaaaatagatagctagtagactttctaaaggagaatctagactatctagtaaagggacggacggtctttagtaaagaaggactctttaggagagagatagcgctcggtattagcgaaggtataactaagaagcgctcctatagcctaggagtaggatctttttctacctattattatataagctcctctccttttttatatactagactttcggtctacctatactattaaataagctcctcgtttatcctattaactaggctatcaattagatcttactctctctaaataatcggtttaggcttattttatataattagtatagcgcctacttagcgtatagccttttcgagctctctattaagcttatcttctttaataaccttagtaatctatctttattagatctttagaggctctattagatactttttataattaagacttttattaaaagttatatcttaaataaatttataactattagtatagaggaactagatcttctaaatattactcgctttataactaactagatatccgatttctactctatagtatattttatctagggtgttgatatatttgccccccctttggctattcctgccccccccccctgcctgattctgcctgattttctggcagaattcttttctgccaggtaaatctctacttttggaatattgatttacatggtaaaaaaatgtatgtttatgataagaaaaaaatgcttattcctgcataactgaagcttttattcgtatataacccccctattttgcttagtctgtatcaaatctccgtagcggctcgggccttagcctcagcctaagcaccttagcgcctcgaccacaagatattcctacaccacgaccacgagttgttcctacgccatgacctcgagttataagaccagggcgctaagtagtaccgcgactcctcgcccctcggcctctacccctaggttcttatgacagtgcgtattcgaacgaggataggtctcggtgaacggatcggtcgtaggcggtaagtaatattaatattaattttaatttttataaatctttactttttataaagggtacttatttttgttaggggtttatatagtaaatggaggtaccactaggagtgctatacttgaccagagaaagcggtgattcaaaaaggaaggcggtgagaagggcggtcagcagatgcctgaatatcaaggcagggggggcaggaatagccaaagggggggcaaatatatcaataccctttatctaattaagggatcctttagatctttatataggcttagtagctatataccctaagatttaaaaggttaataggagtaaaggtatctattccttataagtagaattcctattataggataatctacttccccgaatttagctttatcggcgatctatttaatatatatatagtagcctatactacttctagctagaggttctttaaaagggctaaatctttaaaaagcgctcttactctaataataattacccctctagatcgctttataaagccgttttactctagggtaccgataactattatctatattataattttattctttttaaaaaaagtgatagtcttactatctatcgaatctttattatctaaatagaagatataaattagaaggttaaactagtaataaggtaagcagaggaaagtatagatagcttattagtagccgcttttctatttatatatctctctttagtaatagcgaatcctatttagatagaaataagaaagctagatataattattataccctaatttaaatataattagattaaaataaatataactaaatagtctaaaagaggtcctttatactttatataagatttactactattatctatttagctaataggttttatagaggttaggattataagattcggtatctatagttagagaggaatccttaataatttctatcctatcgactatagttataagctttttaacacgcttactataaagataactaaagcgctagtgctaataaatagtagaagctttagaagtaaggggctatattatacgtcttattatattaaaagtagtagttataaatactactagaaatataaaatctacttatagaagtgtaaagaagtttctaatctcttctagtttatagaatattttactaatatttttattaataatagtaagtttatcgaaattagctttatatccgttcttctttattagtataaccgaaattagattataataaaaaccggaggaatactctacttctaaaagagtaagattaataggctttctaaagcgtccgatagtcctaagttagaccttactagttctatagagctatataataacgtatttcataagcgagctgcgcacacaagcgagctacgcagcccaaccaatatgccaatttcaaatccatttatttcaaccaaaacgctagtaaattaaatttttaaaaaaacattatctatctggatatgtctctctcctatatcctagcttcctatatactccgcacccccggggggttttgtacgcggttgtaaagctaattcactatactaaccgggaccgggtttagctgcttccaccggctatataattagcgtagatacttcttacactaagagaccgctctctacgtatagatacttcctagatctagcacgcttttacttcttcttctcgttttcaccgcgtaaatcactcacttctctctctagaagtgtagcggattatatcgttatttaataggcttttaaaacctaatttatagcggaatttagcggacttaggggggtttttaatctagtacgaagtaatactttaatagaggaagcttacttttctaattgcctatagtttaaaggtgtttttagatcctaatcactaccctagctagggggggaggtaggggttcgaagccgaatatctagcttcgaaatcaccctatctagtttaaaggggactaaaccggtagattagaagctatttttaatagtctctaatttaaaagcttctatctatatagtaggataagcttcgaggaaatctaatttatctatataattagatccgcactgtatccggaattcaactagtctcctataagcccgttttaatatagtaaaatagcctatatctagaggttataaaagataggataaatacgggggtatatagattagtataacccggttttttttatagattttattaaacctcggtattaaatagcttctatagctatctagtattaaaagccgatataccccctttatatatatagtactagggataaatagctttttaagctagcgaagtctaattttattagtagtctagccgttaggactaacttcgaaacgctagtcggaaggaagactatcgaactaagatttaataaagaccttacctttaaaaattaagtatagtagaagggcccgatacgcagcggtataacggccagggttcaaaactctttttactaggggatcttgatgcctggatgccttaatgagtaccgccttttacaccgctctatacaatgtattgtaaacattcatataaacatgaagccttttgctcccatacaaatccatgcatctccatttttggggaggtttaccctctccagcatgaaaatgaagcctttttctcccatacaaatgcatgcatctcccatttttgggatggtttactctctctctctctctctccagtatgaaaatgaagcttttttcccccatacaaatccatgcatctcccatttttgggatggtttaccgactctctctctccggcgcggaataactagtcccgatcgattactagtctatattaaaacttcccattttgcaagctgtcatcccacaaatgtttattccctatacactactccatatatgaactatgccgcgcccgcgtattgatctagagccctataaagaagagatactcgatctcattagccagaacaccacatatgcagacatccgcgctatcctcgaagaacgatacaacatcgtaattagtcgtagtaccctacagagatctcttggttactggaaaccgcctatacgccatgatcttactcttacccctagggtagagatttaagatcgtgttgaagcacttgtatctcggtttaacacaagcgaaattcttcgaattctcgccgtagacggcagaccttcatcggagaggactatcagaaggattcgagcggaccttaatattaagcttcgtctctcccctgattagcgatagtaacaatttgacgatctccaagccattcttatctgtgagaatattattggtgaggttgaggactttggctaccgtactctatatcgctatattcgttctatggggctattttatacagagtaagtgctctactctaattctctatactccaattctctatactccaattctctatcctatactaacctactttagggcccaaattgagcttgcgtagcgtctccttcggccttaagatgtacaaagccggcttctaggttcacggcgcgaacggataaactatatgtccctaggaccaaacgatgtatggcatattgacggacatatgaagctcgaacctttcggtattgagatctatgccacaattgacggatactctcgttacattgtctggatatacgttggtataaccgctcgcactgcggttagcgttttacgctaagccactaatgctttctaagaaagagggtttcaaccaaggaaattccgatctgatcgaggtgtagagactgttcttttagctgatagccactatgagcttcgtcgctaagctgatccctctgtcaaacctaaagactgctggatatatggaagaagtgttaataactagcgtattgaggtatggtgggggatgttatcaagggcaaccactgggctcttctatgtaagtgcactataacttaatatttaatttgattctatactaatttaaaagaagcgcttttttcgccgcctagcacacgaaaactgctttataaaagatagtattcctgattaagtatctcttcttgcagtctatatagaaactatacggaagcgagttaaatcatacaccgagaattggaatacccaccctatccagctctatgctcgccaagaatatctagtcctaggaaagccagcaatgaactttcacttaccgaaaggggatgcgaaggacttcaagtgtgagattgactaagatctagtatcagaccaagcacagctcttaaaaaggctttaagatgatatataggaatgggatcctaatgaataccttccaccgcccacatttgtatggtgtcactagcagctggttgaaattggagaagagcttatagggataccgtttgaccctataaatccggatcttcggtttactagtgactctaagtctctatttgaagcggtgtatatgaagctacgggagcgagcatataggcattgggcctcgggctaagatccgatactcgacgtttgtataaagccaataggtgcagctaagtgggatcctaataaggagcatgcagtggatgaattgggagagaatgtctcggagatatttgatgaagaggagtattaggagtatgtctcggaagggtagaaaatgtatttaatattacaaattagcctagtatatgaatctatctatagatgtctcggttaaaaatatcgttaaaattaaaatactatctaaattaaagcattctctatctaggttcttttatctatcaagttcttctatatttttattcatctacacatttgatatactctctaccaatatgtatttgtcagatgcagcacaagaggcttttaggaccctcttacgggagttcgactctacaactcctacacctacttccttagtagcacctataacgccggcaataccttcgtcagcaataccttcgtcagcggggccttcgtcagcggggccttcacctacacgagcccagtacacaagcactcggttcgctgacctccggagcaatacagttagcggaaaccgccttgcttatactaagaagtttaaggaggcagaggaagctcggaaagccgctgaagaggcgagtaaacaaatcactatgatagtgattttctatctctaggagaaaccaggagagacaaatccaattccggatggtatgtatttcctatataatctagaagcaaaagctaattattacttttatagcttcagtttccgttaaccttcgtcctaaacaaacggtcttgaatatcgacagctttacgagggattactttattacagcgctaccgagtatcgttgatttcagtctagggtggacggacaaatgctactttgctgaggagatgcagtacgcgaaggggaaatatagtcctcgatggatatcgggagtggatgattcctttgacggtactgtgaaggagcttgttgataggcttccaggtcggaaggcgaagctccatgtggttgtgaagcggtataaagatacgtattcattcgaggctgatctatgggaggatgaggcccctttccatgtaactacaccaagtccagcaccagtggacgcagagccagtggacgcagagccagtgagagcagagccagtgagagcagagccagtgagagcagagccagtgagagcagagccggtgaggcggaagcgggctagatctccggttacaacacctcggcggagccatcggagacggagggttagatagatatatggatttgtaagtaggaattaaaaaaaaaagcttcattttcatgctggagagggtaaacctctccaaaagtgggagatatatgcatttgtatgggagaaaaaggcttcattttcatatatggagagagtaaaccatcccaaaaatgggagatgcatggatttgtatgggagcaaaaggcttcattttcatatatggagagggtaaaccatcccaaaaatggagatgtatggatttgtatgggagaaaaaggcttcattttcatgctggagagggtaaacctccccaaaaatggagatgtatggatttgtatgggagcaaaaggcttcattttataataaccctataacgtcagcagaaacagcgtactttgcttattaaggcatatgtaatagtaattcaggtatcttaatttttctgccgtttcaaagtgaggcattcaggcatcaacacccccaaaaagcgagttttgaaccctggccgttataccgctgcgtaggcccgactagtagtatttgtacacttaataactatcacctatttacgatttctaggttataaaagtgctctccgactatagtattcgcttctcgtaatcaccctcgctatcgctattaatcctatcgcgaaactagtcttattaaagttataaacgtcgtccgggtcgatcctaaattataagatagttttttaaactagattaaaccacccctttataacctccggatccttatatttcgcacgtttatagttataccgtttcgaaaactaagaggatagaagagagcgtctttttatatagttcgttacctaattttcgccgaccgaaagaaccggggtagtaccgcgcttttcgaggagaagattcgctatttctcgcactatagacggccggggagctaatccccgggaatctatagagagaatctatttttaaagagtttcctctttaatttctattagtttatacgaatttatacgagaattcgcgcgaaacgtagtcctataaagacgcgaccggagggttgatttaggcacttcgaatcggcgtgctactctacgaatagcgctaatttcttgatttttaatagctttaatagctaataagatcctaccctctctctctattaaatttctagaggattaggagcggtttggtggtatagtgggtggttgaattaactaagtgctaattcatagacgcgtttttggtggggtgcgcagctcgcttgtgtgcgcagctcgcttgtgaaatacgttagtagggaaacactattgttactcccgtttcactattattacgccactagtaccacttacggaatggtcactcttagtagtcagttttcaatataagtgccatttattatagtattgccttagtaaaaaacatagcccccgaacatctctagccatagagtacttctacggtcggtctaatctttaccccctacccctttttatctgattataaagctccccgtaaatcacgtgatctagataaggcttgtttgctagggtttaccgagtccccctacaaacattctggtctcctatagtcactttcacctacacttttatatgcacttttataaccccctttctatcacttttacacccccttttttatcaattttcatctatttaactatcctgattggtattatatcaattaagaaatgcactttgatttaatttttaattagtgtgaaaaatcgataacaaatagataaaaatagatgaaaatagataaaaatagataaaaatggatgaaaatggatgaaaatggatgaaaatggatgaaaatggatgaaaatggatgaaaatggatgaaaatggataaaaatggataaaaattgataaaaattgataaaaaagggggttwtwwragtgtaggtgaaagtgcagcttttactataggagactagaatgtttgtagggggactcggctaaccctagcaaacaaaccctatctagattatataacttatggggtgctttataatcagataaaaaggggtaggggcgcgggtaaagattagaccgaccgtagaagtactctatagctagatatatttaggggctatatgttttactaaggcaatactataataaatagcacttatattaaaaactgactgctaagagtgacctatccaaattgggtactagtggcgtaacaatagtgaagcgggagtaataatagtgtttccctaatagtattacttacttttagagtcccctctatctctttaaactcgataaaaagacttttattattagagatatacttattagttactaaagggaagcgctattagtaatagagttaacctactagtaatagactagtgcccctttcggaaaggtcgctcttagtagttagtttttaatataagtgctatttatgatagtattaccttagtaaaagatatagcccccgaatatctctagctatagagtatatctacggtcggtctgatctttatataccccccccccctttttatctgattataaagctccctataaatcacgtgatctagatagggtttgtttactagggtttgccgagtccccctataaatattctagtctcctatagtaaaacctacacttttatctacacttttataacccccttttttattaattttatcaattttacacctatttctatctatttttatcggtttaaaaacgcactttgatttttactttaaattagttttaaatataggcaaaaataaagcttttactataggaaactagaatataaattaatattaacatttatatatagattttttatttatgtacggactcggttaaccctagtaaataagccctatatagatcacttgatttatagggagctttataatcggattaaaataatcggataaaaagtggggagggccgatcgtagaagtactctatagctagagatgtttaggggctatgttttttactaaggtaatactattaaaagtagcacttatattaaaaactaactgctaagagtgacctttccgaaaggggcactagtctattactagcaggtaaactctattactaatagcgtttcccttactaaattaactagctatctatctctaatagagctttatatactatttataaggaaagatatattagttagtaataaagatagtgttgaggctacgaaggaggactgctagtgagaactagcatgaaggggaaatcgggaagaagatgatactatgaatctatggaaaaacaggctgtatatgaagcctgtactaacaaaggaatggcaaactgacaaactgacatatcaaactgacaaagcaaaagctcagtctgcacaaagggacaaaggcataaagacataccataccatgcatgtcaacacacccccccagactgagtatcaaaagcaaaaatcaatctggtttgtatagtaaaaatcatagtaaaaatcatagtaaaaatcatcaaattagtctgtcatttccttcttgctcactagtagttttcgaatcctttcgaagtcgacttttggtagtgcttttgttaatgtatctaccgggtttcccttgctgtcgataagctagatatcgatctgcttcgtctttatagtatgtttcacaaattgatatttgatatctaaccacttagttcctttattgtaggagtccttcttaagaattgtaacggtattatcgctatccgtataaattggaattagaattagcttcgtgttatctagtaatcgtagttagagaaggatctttttcaaatagagtccttctcttactactctattaagagcaatgtatttagcaatagtgcttcctatagtaacaatgtcttatttccgtgagctctataaaactagcgctcctatatagtaaaagacgtatacttcggtagatttcctatcttcgcagtcgttaaacgaagagttaatatagctacttagtgttaaattggattttgctagttatatcctatagctaggtgcgccttttagatagcgtagtagttaggaaagggtattaaggtcttactacctaggatttgtagttcttctctatagtctatttatagtaaaagcgatatcgggtcttatacgtatacctaactaggtaaccttactaatatcttctctaaaagctactttttcggaggaagaaactatttccgaggaagagactatattagtctctattatagagaaaggtggttaataggatagctttataggtaggtatattaataaaaccttgcctagactcgctatctatagcagatcttctaggtatatagcttagtcgataaaaatagttaataaagcttcgttagtagttcttattaagctacttcctagaaatctagctagttcactaaccactttaatcttaaatataatattatctttaaactattagatctatcgtttatctaaagtagcgcttaatatatcgttaatatagagtaaaagctagagatctctctctctataggtgaaaatataccttttatccggaagctctttaaaacctagtctttttagctcttcttttagcgtttcgtaccacaaatttgctaattgccgaagtccgtataatacttgctttagtatatagactttactagatcctaattggtctagccggaaaggggattcagatattgaagaaggattaccttagtagtatccggttagcggtcttatagaaatgcacctcttattaataagtgtattaagatatatagtggtatagtcaatttattcctattatatatttcggatagtaactatagataggaaaagtctagtgctttcgggtctcgctaccggtgtataggtttcgttaaaatcgaatcctagtcgctagcggttgctatagataacctatctagctctcatttctataatataatcctccttattatatttgagatcgaaaacctactttcctagtaggatagtgcttcctttcggcgggatatttactaattggtaagcttatatagcttctaacttattaatctagttatctattacttcctactaaagctctttctccggggaatttagcgcttccttatagttacggggaatcttcacttactatatctttagaccttccgggatagtagtaagagtaatactaatagcggataaagctcttctatatatatcctattattatttgtcaaatcttcttagaggaattcctatagtctagcgtcttaacgtccttagctacggtataggagtagatataattagatccggggaagaagagtctatatctagtcttctctctctctctctctctaatagagaagggatagatatagttcgtgcgcttagtgaaagggtctataaacctattattagggtttttctagaagtaggtcccttacctttctccgcttatataggggttataaagagagtattttctttgtcttcgatttcttctatacgtaaatctaatagcgggagataaactagttattaaaccttactagtagtaataactagcgaactaacacccctataggaaatagggatagggggactattgatagtgtttcctcctataataatttccctattattagtgtagaatcccctatttttgttcctaaaagataatatcccggtgtctagaaaccttcttcgttttaggattataaatcctatagatataactattgttaccctcgtatctaacgaggtagccaatctataccctagcttctattttctagctttaaatccgcttttctttcgggatataaatataagcctttatatactatactcgaaggaaggaaagagagacgttctccggggatcttatatttaataatttcctctatactataataggagcttattagtctgatttctttagtcggttaataatatatatagctatattaatagcttctagctagagttcctatagtacgctagtatcaatccttatagtgcgtgcaatctataggatataaaatctagagaactcggaaacactattttgcttatatatatagggagctaataaagtgactattatatttatcggagctaatttagcttatttagtaaaaacagagaattctataccgctatcgatccgctattcctatagctagtatcctatcttttagtatatctcctaagtaatttctagagaactagagaagtatccgctttagtagcgagatatagtgtaagacggtatctagttatatcgtctataataattataatatagtttctattaaatttgctagtattagatttagtatctagattaaatctagggggagatataggctatagattaatataaaatatatagcctactctagttgctctcgcttactaggagcgagatataatcctctttaatttaccgagtttgtatacttcgtagttatatccttcgtcgtcctagtgtatattatagcctaggtccgcttagttaatttttatagtataactactagtataacctagtctctagtgtgctagctctatagaaataactattacaccgagagctagggaagcgagttataaaaataggacttattagtgtattctagtatagctaataagaatattatctttatataattctccggttttgctattctactagattcctagctatttttcggtagtcctaagtgaaaatagattgtactatctacccttcttataaatatagtgaatgctaatttaatagtaagctagtatcgttcggatagctacttcctaagctatatacacaatatcttcggttctaatataaagtgttaaattaataatgctatatacgtctactttaacttttttattaccggaagtctactgtttatattcctagctagctatataggcctatatagtggaaaacgtagtttcgtcactatagagatattccgaagcgctagtatctaaagcctatagataacctagagctatagtagatagctaaatagtaataagagtataaccttagtcttattagtctctagctctagattgctagataacctcttttccttctttttagagggaattagtaaggtctactatacctatattatcctcccggatagtagtctctactataaccctcttactgtaccggctctctacgattatattcttattagaaccgctatctttatagtagctctctattataatataagaaggattgaaaccttctttatagaaattgatattgatagatattataataaacctagatatagatccggtatttagtgtagagagattcgcctagcgggtcctatctatctaggatccgtatataggctgaattttatcttatttggacttagtgctattagataccgaatttgtcgatttcttatagatctataatcctagcgttagaatctagccttagtagcggagattaggatatagatagaaatatttgctcactttatagcgtcttttgctatagtaagtgcaatttctattatcacttttctctagcttatacgctagccacttctttatatactcctccgtagatataccttttagcggcttatttataagcgtagtgttattgttagtagtgttcgaattagtcgccggtatagtaggagatccggatagattaggagatctagatagattggctatacgcttcttaaaagtagagagagcgagagagtttatattgctagatttgatataatctagaattgtagtactataccgataaaaatcgataatagtaattgtctttataggtttcttaatagtattaagctcgttgtcttttataacgataaaaccgcttagttccggtatatcactaagctctaataatatagtttctagagcgtagtatagaggaagttctctattaagatcacaaacagctttataacgaagctttatagtataaataaagtccttatttatcgtaaattggctctaggagagctttttgaaacttcttatagctgcttttaaagcactataaccttcaccctttatatacttcttcaattcggtaagaaagtcgtcggcgaaaccaatttttaatccacgagtattaatttcctaaactagggtgtggtctatactactcgttatctatatcctaacttatagggagagagtatactatttctctctatttagattgttaataaggggctataggatatcggtgttaattagattgtaaagtttatagctctataggaccttttccacttagtctatctagttgtcgaaatcggttcgttcttttagcggtagggtgattttgtagagattgaaactccctacttctagtagactaatagattggtctataacaataatatcttacttagtatactagtctcggtgttagaggtcacgtgacctcctttgctccctcacacattagctagcttctcctcagatagtttcttcccttcttcacgcatctatctattttccagagcacactacctttccctgtagtctgtctctatcactcggtttcctagttagttagaggatttagctatcgtggctgatgaaaaatgaatatagatctcaacgtgagatactataataaagcttctttattaagaataagtgataaagaagtcaaaaatgcacccctctttgttaaagggtatatacaagtcaaaatctttgagaagtgcaatcactatataaaattctcaaagaaaagtgagagaaatactatcgtagtatcctctaaaagttagagatatagcctttaaagctagtctctaaaagtgacgtaagaaatagcctattgatagtgctattcttgatggtgaggctcccccgcggggagatgcttatgtaaagtctttgatatagcaaagatttttatagtaaaggggtaaaacgagggccttataacctgttgaggctacgaaggaggactgctagtgagaactagcatgaaggggaaatcgggaagaagatgatactatgaatctatggaaaaacaggctgtatatgaagcctgtactaacaaaggaatggcaaactgacaaactgatatatcaaactgacaaagcaaaagctcagtctgcacaaagggacaaaggcataaagacataccatactatgcatgtcaacactaatacctaatcttttagctagaatcccgtttttataactactatattataaatccgctactttttaatagcgtaaactagtagtagctcgtttacctttaatcgagcgtccgagaggcgctagatctacccttcctagtcctcttatagttataggttaggggaatcgtcgctattagctattatccgcgggtacactctatatattaagaaatataggcttcttttcgataccgtatattcgcgaatacgtgctataaatactacctaaataaggtacttatcctataagcgtataggcttacctataaggtatttcgtaagtatctgtctaactagcctattaaagttctctaccttaccgttcgtttaggggtaatagggcgttattatataataataggcctagattagctataggaagtgatgtatagcgccggagagaaggtttaggctattatccgagattagctctataaacgcactatagtacgcgtaaatatctcggtataagaactaggctaaggcctcctctatagcgtccggaacggcgtacgctaccggctaccctatagcgtagtcgatcgcggtaataatctagcgattactattagaggtagtcggtaatcgactaattaggtcaattccctaacgcttaaatagccgttcgccctttattactatatactatatagtcttacgctctagactagcgtgtaaaccttaggaaacttagtagtttagatagaagcgtactacttcctcgatatctactcttatagagggctactatctataggggcgaatcaccctatataggctaggaaagcctagatagccgaactcttagtaggagttatagacgagatccttatagaacggagccttaagatatagggatatctctctattatcgtaagcgtaaactagttagcgattaacctccggtaatatatatctattaattagcacgtcctagaaacttaggcgcgcggtaaattcctttatagcctaaacggtcgcgcggttatccgattccgtactatcgtctaaaaaccggatcgttactactaactaatcttccttaaggacgctacgtacggccctcgctatagtaaggcggacgtcctagctagcccggtattagcttatatttataggggtttcgccgattagatctagtcgtcgactaatagtatctataacgatattttctaagcctttccggtagcgtatagctagccgatattcctagaactcggtaatctagcgagctaggcgcttactatactcttttatagtattaagatactataagctagcgttatcggtgataattatagtctcgaaccggttactatcgatatatcgatcctatatacgtgtaagggaatttgggctctggaccaaattctccgccaaggatactctttccgataaacaagcgtttaccaaaaagaccacttatgataaccggatggttatcataccagagtttccactatacccgcaaattggaataccccccgtattttccaattgcgaccgagatgatctactttgtggacttgcatagtttatccattacaattatctccccctttccacgggccacgtcctcgtggactatatatatatagtatacgtttagaggccttaggtatgacgtttaggggccgaaacctattcggggatgatatgccctaagagctcgtatcaaggttatagtgtaagtctcaaaggttggcacctagtgctagtgtgatcatgcctgatttcaggacacgtgaccggactagttataatgctcctttaccaagggagagggtagaaacgacgcagctccgtttcgaacccgggccctcggctatccggttatcataattgtaagggaatttgggctctggaccaaattctccgccaaggatactctttccgataaacaagcgtttaccaaaaagaccacttatgataaccggatggttatcataccagagtttccactatacccgcaaattggaataccccccgtattttccaattgcgaccgagatgatccactttgtggacttgcatggtttatccattacaatacgaatagcctccttaatagctaggagttctttcttatatataggatagttaagctccgccctataaagtttcctactatcgtatacgactaggtagaggattctattatcgtcctcctatataaggacggccccgagggcctattccgatatatcggtttcgattatatatagcttattacaattaggttactttaagataggtacggagactagtaattctttaattctataaaacgcgcttttataggcggtcgtctatataatagggcggaaacgtttcctttatagggaggtatcgctcttctttaatagtttatatagcgggatatagattttcgcgaagtctttaataaaccggcggtagtatatagctaggcctataaactaacgtacgtcgtatatattcttcggcctcggctaggcgtctatagaggcggttttagccgcgagaggataaatatagccgtttccgataacgtatctataaaattctagctcctagatagcgaattagtatttcgctaaagaagcgtatagtttctattccgctagtaaggctaaggcttactctaggtgctagtagtgttcgtctaaggacgccgagaagactagtatatcgttaaggtaaactaccgcgctttagctaaatataggctatagcgtgttattaattatagattagaacgtcgctagcgcgttataaagcctaaacggtatcgtaagctatttatatttaccctatatagtattaaaggccgttttttctatagcgccctcccttatacggatctactagtatcccgcggttaggtcgattttcgataggaatttagcgttactaacgacatctaagagttcctagatctatagtaataggtatctattcttctctataatttagtttagggctcgatagtcgatatatatacgctattttctatttagtttcttagcgaatactattaggaacccttatacgctattcgagtagcgaattaggccctttttaataagctcctcgatctaccgcgcttatttatctagtttctccgctgagagggtataggcgttaatatttatagacttagcgccgcctatatcgatatcgtacgcgatattccgctccggcggtagggctatagggagctctaagcgaaatatatccttatatttctagaggatctcctatatctataggttttcgtgctatagtagttccgactataatatagaggggttttcgggggtagctcgtactataaagagccgcgcctctacgtttcgtttataaaagatatatataatatatcttatagagataaggttagcgtatacgtctccctttataattatatacgagctaacggtagggtatatctcgtatattctatatatatagtccgttaacgatataacggacgtctactaattaatatataggttttcgttatataaaaagtcgcgcctaaagataatatcgtattcggtctctaaaacctacactttaatatagcctatctaccctcctatcctaataggtaggataacgaacccggctatctcgacttatttactattaataatagtaactagtagcgggatcttaagcttacgtacccttactacgctatatagcttctaaacgatatagggcgcgacgaacgtattactcgcgctactattaaagagtatataggcgagaacggggtctatcgccggtatctatatttttccctagtagtacgttagcgaatcacctataacgtttagagaggctaataaatatagcgactttaggcggcgtttatagtactatcgccgcctagttttccttttctattactataggaggactaactctagccggattcgcgcctaatcggtagtatcctagcgcggatctaacggatcctccgcgtctaggggcggaaatttagaagcctcttaaaggcggccgataagggcttctatattatatagccgcactagttttccgccggttatatatagcggtaggataagctcttctacctctttttagtttcttctatcttcggcgcttaatacttccgggtaagataactaaccttcctatagttatagtacgtatacgtctctaggccctactatatagccgcggctataagctctataatatcggggttaggagcggctaccttctatcggtagtttataattatagcgcctaccttataattaataaaaaggagttcgacgttatatatctctatagtttaattcttttctaccgcctactaggcctagaagtctagttttatcctagcgacgaaatagtaaataagtaattattctaggatccctatatttaagtccgcggccgtttactttaacctagatacgtatttagtaatcgatatacgtccttattttatattatcgaacctctcctataggcgtttatagctaatatattctataaactcgcgctaaacctatattttaaacccttcctagctctcgaaaggttctaaacccttaatagcctaggcctatatatagttcttaagccgctcgctagcgtcctttactagtttaccgctagcgtagataacccttactatactaggagttttataacgtaatccactagcgagctggccaccctacaaaaaacgcgtctatgaattagcacttagtcaattcaactatctaccataccaccaattcgctcccaatcctctaaagaatcaactaagcaagagggcaggatcttattagctatcaaagcttttaaaaataaagaaatctcttcaatttgtgaaactacgcgccgtttcaaaatcccccgttcaaccctttcttcacgtcttaccggaatataacaccgcgcgaattatcgcgtaaatttgtgtaaactaatagaaattgaagaagaatctctttaaaaatagattctctctatagattcccggggattagctccccggccgtctatagtacgagaaatagcgaatcttctccttaaaaagcgcggtactaccctagttctttcggtcggcgaaaattaggtgacgaagtatataaaaaggtatcctctcctatcctcccggttttcgaaacggtataactacgagtgtgcgaaatgtgaggatctaaaagttataaaggactagtttaatcttatttaaaaaactatcctataatttgggatctacccggacgacgtttataactttaataagacgggttttgctataggattaatagcgactacgaaggttattacgagaagcgaatactatagtcggcgagcacttttataatctagaaatcgtgaataggtgatagctatcgagtgtacgaatacggctagttaggcccttccactatatctgatttttaaaggtaaagtctttattaaatcttagttcgatagtcttccttccgactagcgtttcgaagttagtcctaatagctagactactaacgaaattggacttcgctagcttaaaaagctctttattccgaccacttttatacggataaagggggtatatcggcttttaatactagatagctatagaagctatttaacaccgaggtttaataaaatttataaaaaaaaccgggttataccaatctatatacccccgtatttatcctatcttttataacctctagatataggctattttgctatattaaaacgggcttataggagactagttgaattccggatacagtacggatctaattatatagataaattggatttccttaaagcttatcctactacacggatagaagcttttaaattagagactattaaaaatagcttctaatctaccggtttaatcccttttaaaccggatagggtgctttcgaagcttgatattcggcttcgaacccctacccccccccccccamccccccctagctagggtagtgattgggatctaaaaacaccttcaaactatatacaattagaaaagtaagcttcctctatcaaagtattgctttatataagattaaaaaatcccctaagcccgctgaattccgctataaattaggttttaaaagcctattaaataacgatacaatccgctacacttctagagagagaagtgagtgatttacgcggtaaaaacgagaagaagaagtaaaagcgtgctagatctaggaagtatctatatatatagagagcggtctctccgtgtaggaagcatctgcgctaattatatagccggtggaagtagctgaacccggtcccggtcagcatagtgaatcaggtttataaccgcgtacaaaacccccccgggggtgcggagtatataggaagctaggatataggagagagacatgtccagatagatgatgttttttcaaaaatttaatttaatggcgttttggttgagataaattgatttgaaattagtatgttagataaagtggctagctcgctagtggattacgttacctagttagagctactagctcgttaaagtaccgattgtagtcgatcgtccacttaagggtagcgttatttaagatagtacctaaatagttttcgatagcgcgtaggttatttagtatagatttcttaacgtccttatctatattactaaagtcgttattatttctatatataaaaacttataaggatatagctatagaatacgccgtagtcgattatagcggtaggactattactaatagtagcgctagtagccgatcggctagaagagaacttagctataagagcttagcctagtacgtttctagcgctcttacttattaagcggctttatatagaactaggtaagcggccttaggcgttatagtctaatatatatataagtatatattcgcctccccggtcgtaagagcgtctagagcctactagacttctataggaagtctcgcacggacttacttagggctcttagtaggaggtttaggggtacttatattattagttactttaaggaattataaaacttatctagtagtgatttatactactattctactataggggagccttccttttaagctaaaggcgcggctctccctagatacggatctattctaacctatctatcgcggacgcgtagggggaatacgagtttacgcggctattcttacgcgttctccctcgctaaatacgagtttacgcggcggtaaaccccttataggcctacccctactaggttacctcttataggtatcccttagtgcgtcgtcactatcccccttcctctagaccgctactccgtgcgttcggagtatatagtcattttcacgaacgctctagataataggtccgctagatcgtgtgtcgggcgcgggtacgggtaagggagtgtggatactcgcgtatagtgttatttacgagggtttacgctattatataggctcacccgtaccgcccttaggcctctatagaaggagcctttaaaccgatatactaccagatgtgattcagaaaggatcgcatagtttttgtattagactagaagtactaaacacctatatacaccctggtacgggggcgtaaaccgtccactatagcaaataccatagtggactaggaccgagtccgtacagtcatgtgatcggtcatgtggcctcacgtgaccgtaagtgagcttacggatctcactagcgcccgcctctagtatctagaactacttatagagatatagttatataaagctctataaggtttaggtcttacaaggctatcaagattaaattagtaaagagaaatactatactttcctaagataggagactagtcttatttatagaggtagaagtgagagtcctttagatatcttataggtactaattagtagattccttattttagaaacgccctcctttatctaaaagtcttttagattactctttaataaccgttaagaagctaattttatactcttactacctattttacccctttattaaaagaccttaagtcttataaaggcctaaaggcctttattaatactattcttagagacttactaagatatttcttttatttatacccctatatatctatactatctttaacggatctaattttatacgtacgcttatttataatatctttctaggatcttaggggagtttttaagcttacttatataaccttcgggaaacggaggaccttttcctattcggtaggggaggatataatcctagaagcctatttccttatataaatatatcttatatcttattagccggatctatatagatccgtttctacacttatatacactatcgttaccgtattccgtagtacttagtcgttagtaaagctaacttaatataaactatgcgatcctttccgaatctcagtagtaaattgattaatttatctatatcagtttttaaattaattaatttactacgtggtagtgtagtaaatcgatactaaagtaaaaagtaggaaaaacgttataaataggtgatctattatatctgggtggcagaccctcgcttacgagggtccgtattttttgttaaaaatagtggggccggttagttaagtttctagaggattaagagcgaattggtggtctagtaggtggttaaagaagaagggctatgttaattgacccgttttttttagtggggtggccactcacttgtgaaatacgttaatacttacaatctactgtccggtacgggcttacaaatggaaattaacgggtgggaattggtatatgaacatggtgaaaatacagggcatggaatattatagacctacctctctactagacgtgcatcgatggattcatctggtgttgaatccttcaatgggaaatgcaaaatcgagacctacccgatcgatcgcgagaggcatgtgaccaagactttaagagttgcactcccatgattcctttgctgacatgatctcaagaatcagaggcgtattcagcaaggcctctttcgctgcttcgtcacctgcagctgctttactcaaaccctgacccgaacccagaaaccttttatcccatccccacccagtgagaaataacgcgacgaagaaagtctgtgtgccacccttctgctgaattgatggacgctcctcaatgtattcaagcttgacatttttccccataatcttcttagcaagagcttccttggagcgtaactcccctttctgatgtcccaagttgtttagaatcggcacccataaacctgatagccaatgctctgccagctcatagccagaaacaggattggatagtatgacagccgcgacgtaggcttcgaatacgtccccctttgtttttgtccatcgctttgacggggtattgtagtttggcggcacggaaaccctgcggtccaaaccaaatctttcagcgaagccggaaagcgtctcattcttaacaaggatctcccgaatctgtgatattcgacctgcaggtaaatctggaaatctctcccagacaagtttggttgcaattagctcgatgtatgcatcgcctaatatctcaagtcggtcgtaggtcgtgttgatattattgctaagagctggatgggtgaagacagcaagttccagcttttcatccatgatcgggggaagcttagggtcacacgaaccactgaccaagttgaaattgtgatctaagtggtgtgattttgggaccccaccagctatggaagcatctctggaagacaactgattcttcgtcgtacgaaatgtgtcatccagcctcgaaacggcatccacaatctccgagtcagcgccaatgagatcagaactggttgaaatttctcgaacaaggtgttgtagaataagcagacgagaattgttgctagatttggccatgccgcgactgacgccaatagaggatttaggatccgatggcccactcgatttttgaacctttaaggaagtagttagcaaattaattgaatcaacaggaatccactcagtgggatgagagcatggtattcaccttgggccgcttttgtgagttttgtgtggcatctgacccaaaggcggatgatgatcttttcagatctaccactggcctttttgagcctgctgaatttggtatctcgtattgagacatgtcaattgttgtagaccttgttcagtcttgagtccagcttttgctgtttttaccctttttctcttgaggtaaaaacatggataaatatgtaggcggtatacttcggatggtcacatgaccatcgggcaaagttcagatgggtatctccccgagttcgatgtctaccaagctgctgtgaacagctgcttcacccatttctttttgcatatgattcttctgaccctttaaggaaggaaaatggcgcccagtcggatcttggatctggttaaggttcaaccacccttttcattgtgctgtgctggcattcactaattggcaattgaattctctagacccaatgccgcatattctctcttaatttcaacccgcaacggcttcggcttggaaacaaggtcttgagacagcgcttgcgtgggccagcgcttgcagcctggtacccaaaacagactgtgtcttttcaggatttacaaaacacttataagcctcttggattgacgacatttgatgaagctgaagatgacagagaagaagctattcagatgtaagaatcgacaccccatgtcacatacattctcactaaacatctgattcatagcgccaaattgcgagggaagggccggccgaagaagaaaagaactgctgcaggtaatctcctctacacccgacggtttcatgccaggatcaaaacctaatacttcaacagaatcgaggtccgcaaagaagaagaaataggttgtctgcctaaccttctaggcatttctgagctcaacactgcaccactcggatcaacgccggcacattctatacccggattatctatccatgatttggctgggctagtgagacactgcgttgaaaaagctgttcagatccttttgttcaggtgcaaattgcctaaacatgttgttgtcttcgctgatagtctcaccatccgacacagcttgttttgtttcatattttgtataatacgttttctttttttttggttcttctcatgcgagcagttcattggaacaataccgaattctacaccaagaattggaccaaacatatatatcaatgtacattgggtaggccgtggcatgagattagcactttccaaggcttccaagccctggatatccctcgtatcttatatattatgtagatgattgtacggagtagagtggcaaaatgtaggcggtaagacattgtacctggatgcacgtgatggcaattgagatgcaatatattcggttttttaaccttgcccgcctacttcatcgtctttcgctacctaaatctatcattgtgcgtacttgaacaaagttttcgttgccagatttctttccatttctgcgatattttccaaccggcaccgcgttcattgagcagctgccaaaccttccagcaaccatgaaattgagcaagaaccagctcagaagagccaaaaaaaaggcccagaaagccgaggtaaggcagattctatggtctctcagtaatagccgatgcaaagctaacactactgtaaagaccacgagctttccagtcgacactaccatgtcacgggaacgttcacctcccacagtcgctacttctcaggatgcaccggctgataccagcactgatctgcttcccgagccaactgatccactatgggaaatgtacaaaggtgttgtcggaaaattcgacgagacagtgagcgagagttcattgacgaaggataccgataaacccgaggtcttctttgacgatggtgatgaaatacccgacgaggagcaagagggcgagcccaagatttcaaaaaagaaacggaaagaaatgaacaagctatccgttgctgaactcaaagcaatggtacgaaagcctgaaatcgttgaatggacagacacatccgctcctgatcctcgactccttgttcacatcaaagctcatcgcaatgtggtcccggtaccctctcactggtcgctcaaacgagaatatctctcatccaaacggggagtggagaaggccccgtttgctctcccaaagtttatacaagagacgggaatatctgaaatgcgcgacgccgctttggagaagcaggaacagtcaagtttgaagcagaagcaacgagaaagagtgcagccaaagatgggaaagctggacattgattatcaaaagctttacgaggcatttttccgcttccaaaccaagccagagttgactcgctacggtgagatctactatgagggcaaagaatacgagaccaatctgaagcacctgcgacctggcgaactgagcgatgagttaagagacgctcttggtatggccccaggagcccctcctccgtggctcgtcaaccagcagcgatacggtcccccttcttcctaccccgcgttgaaagttcccggcctcaatgcgccaccgccccccggcgcgtcgtggggctaccatcctggagggtatggaaaaccacctgtcgatgaacacaaccgcccattattcggaggtgatattttcggtgttttacaacctcaacaacatgcgcagcaaggagtgccgattgaaaaagatctttggggtgaattacatgaatcagaagagtcagaggaggagagtgaagcggaggacgaggacgaggacgaggacgaagaagaaagcggcgaagatggggtgggtgcaggtgctcattctcctagtggcttggaaactccaagtggaatagactcagcagtaccgtctgaatttgttggcgctgagaatgtttctggggagttcgatgtgcgcaaacaccatcgtggtaccgatacagaggaatccgttcaccctcgcagtgcttatcaagtcatccctgagaggcaaacgaacgtggaaggctttttcgggggtgatagggcctacgatcttagcggatcaacaggcaaacctcctgttctcggcgcagatgaccaaaaccggaaacgcaagaagcctggggatgttgaagtgtctgtcaacttggatgcagttcaatccggcgatggcctcagcaaagagagcctccagagcatgtacgagtcacagaggcagcagcagaatccatcaaactgggctttccaggaggacttgagtgacatgcttgcgcaggagaaccgcaaaagattgcgaaaggaagaggagagacggagaaagcattaaagatgcttctttcagtgtacttttttattttctttcgcttgagttctcgaggcgtgcttctttcatggtgagcattggagtttggctgctttggtgtacactctgttcaaaaaaaaaaaggctatctggcctgtaatgtacggttagttttgaatcaaagttcttatgaataatctacgaaattccgggtggtgtgtctgtagattgtctgtggaaatcttcccagtcagcatagcatcttgcccaggtgatatataccttcatacatcgaggcccacagtcacgggcataggttcccgaaaaggtttagctcagtcctctctaccgcatttcgacactacaatttccttgtactttgttgtactttcgccttctctctctaggatacggagaagtagcactgagtaactgtgtgctcctgtgctcggatcctttgccttctattacctcccggagtacttcagccatattatctacgtcagaatggagtgggatcgcagaaggtttgcaggtgcatcgaaacgtctgaaatgaagtttctaagaatttccctagatttgatgaacgaagaggtggagaaagttatcgtccagccgacagaaacggtcgttccccttctcgggcgtatgaaattcgtcaccgccgctcgccgccgcgaacccgaagccctcctcgaccacgagcagacacttgggtaccatcatcaaatagagggtatgggcgcacacgaagtcggtcaccaccataccggcgccgctcacgtactcctccgggaagaaactttggttcacacccctacgaaagacggcgatccccaccaagaaggttctcgcccagaatctcgcccagaagagatgaaagggccagatcaccgccccaaaaatggcgctcaaaatccccctacggtgatggtagatcacacaacggatcccgtgctcgcaacagcccaagacggatacgcgatacaacccctggcagccaagtcttccgatccgcgagacgagacgggcctgctgtcttaaatattgacaaacccacaagacctccctcgcccagagtacaggcagaagccttgttgccacagagtccaattcatccctcgcatcgaggccaccctcgtgatgcggcgaaacgagatcggactttgtcgccatcgacacgcgtttcacctgcacacgccttggcctcacaacccgccctggtatctcgatgttcatcgccggatgtagaaaagcctgttgtgatttctcgcagatctcgcagtcgatcgccgattcgctctccggtacccttacaacgttcgtcgaagtcctcaggtcgatctccgtaccgggatcaggtctacgatacggagttctctcacccacaacaacggcaagatcacgaggaccgagtatcgtttggcaatcattcgcctttttcgattagagcgcatttggaacctcagacaagcgggacccaggttggtggcaacatcccaactcaaccgaaaaaccacagtgcaagtccacttccactgccgccatcaggaccttatcagggaccgaggccgccatctaatcagcatcgcggtccttcccatgcctctttactatcagcgcctactcgtcctcgacgaggacctggcccacgtgaagcttggacggggtccccgccggtacgccgcggacctgttgcagcttcgcatgccccaccagcgggtcctcgcgcttccttttcatcccccgtaccaggtggcagttaccgacatcccacttctcggcaacccaacactccgtctgtaactcaaccattggcccagaagggggtcaaccatcttgcggggctatgcaccatcgtaccggaaggtcggagtcttccgtcgcttctagatcctactgtggagaagcggttggctcagcttgatgccgacaaagaaaaactccttgagcaaatcgcggagacgcagaggtctaagcgagcgggacttcgagactgggatcgactcgatcgcgaaagctcaatctgcgcccttaagagcgagctagctgaaggccatctccagcgaatggccgatgagagtattgggagcggaaacttgttctagcaaggcacgtgtacatctttgtcctacaatggcaattgatctcggcgtttttatctggccatgtgtcgggtggcgtcaaggtgttgggcaggtctaggtagcggtttttctctttccatgttgtatcaatatgatgacttgacgacattatgtattgaggtcctgttatatgaatatgtaggaatgtattgcgcttgtagacatattaagtacataagaaggagtagatatctgatagatgcaatgcctgtatagaagtcaaaccacatatacacatatactgtatgtatgtacatgatattcaatgcaaggtacatatgtacctactatatgtagtagggggatcttcctagatcattgttatcggtgctaagtacaattctctacttcaagtaaagtatttccctggctaaaatgcacacattagatacttcgcaagcgtgtacttatatgtatatacgtactactctacgatttaaggtatgtatgtctgtatgtccgtatgtgtggatgcctggatgcctggatgtcgtttttttgtatgcactgtatttaccgtactgtatatacatgtcatgtacatagtgcgtctctattgtacctgatctgcgagtaatttaagttccccttccgtttcttgccttcgtgtcaacaactcggctgttttggtgtagactcctaccaattctcaaactcgcccccttctccctttctctttctccctcctggcttaggtcaatattcacactgttaatcgagatacatttccggcataatgaatatcttcaggttattaggtacgacataaaaccaatgcaaaccaacgcgatatactaacgctcaatcgcagccgacttctcccatctggcgtcgatcttcatgcttttgcagaagatgaagacgtcaagtgtatgtcctcctatccacgaagcctcatatgcttgcgactaatggcggatcgcagagttgctccgggttgtcgttcaaatcgcaggtgctataccttctcgtttttgtcactcgttacctcggtaggttacgttgccgtcggcttcggctttatgttcataacaatcgctgacgcgctttgtagatcttttctggacattcaccgactctctgtacctcaccacgttcaagcttctgtttatcggttcctcggcctacgtcatctaccttatgctcaacgactacaaacccacacatgatcccaacattgatactttcaaggttcaatatctccttggaattagtgcggtgcttgccattctctttccgcgcgattatcgcatttccgaggttggttgcatcctgtctatggagtgggaaaaaaaacccccaagactaatgtcatgtagatactttggaccttttccatctggttggagtcggtggccatattgccacagctattcatgctacaacgaaccggggaggcagacaccatcaccacccactatctttttgccctgggactctatagggcactctacatcccgaactgggtcttccgctatttcaccgaagcctccttccaacgttcattccagcctgtgaccattatcgccggaatcatccaaacgctgctttactccgacttcttttacatttactacaacaagtaagcccaattgcctccaacaagcaaaagacagacgtgtggtgcaggcactgacacgcgctctttttttctcctcccagggttctgaagggcaagaagttctcgcttcctgtttagatttctttctactttctgaatgtgttaaggaatttatgatatcttaggatcttccaaaggttcggagatggaattttgaatctgatccgctcgttccttttatatttgcctgggacacgatcacctatcccacaagcaccaagtgccttgaaccaatgcaacatccctccaagctccgacgctgggtgttgctatgaactaatgttttcatgtcaccaaatctgtatgcatatagggatggtcacatgaggcaatcaacccgaaattgactaccgaatatcgaatatctcggaccatgtgcatatctgattgtattctatgttcatcagtgaagggaaatcgtctttgtcaaaacttttgtacttttaggtcatcggcctaccctttttaatgtagcctatgttagatgcgagatccaagattcaagttcaactattcaattattcagagtattcttttgctttgctttttttaaatcgactttctcttttcgcttccattgaatattgacatcccttgtctcttcgtacactcgaagtcttgtaacggatggcaatcaacttctcgcccggtccgtgtatgtcacccatcagacctgtgattgacaaggaggcataaaacgatctagacgctcctggtaaggtatacttttggggagtacacagttagtataccctcgataatatcaaaaagcaacatccacacaaggtcgaccagaaatgacaattagaactctcgctggggcgcggtcccatgcgtcgggacatatcccgtcgtgtagctcaattgggacggagggatggataaatcggcggagaatggatccaaagtgccggcaattgagtgtgaaagattggccatgggaccctggaacgaccgaactccgttacctagattcgagcgaccttgcacattttgatgactatccaaccagccactatgaccgtgtaaatgaccaaaatagtctgcttgcgtcctgtcaaggggaatttggccggcaaacgtcgattctcgtcgcgaaattggcggcgacgggagtttgggggatcgagagaccatctccagtctgggggagcttcttcgcgaattgggcggcgtcaagcgtgatcctccacggcgcacctgacaggttgggcagatcttcacgaagcgagagatcaattccttaggaaccctaataaaatagtcagtgactgtgaaccagacacgccatgtacatatacaatgcgactggggtttgcccaccatgaatagattcgccggacctgagcagatgtcttgtctcggccaccatgctggcattgctgatgggccttggtgaggattttgaataatttttcgcgaattgcaaccggctttccctcgtgacagatcattttcctatgctttatgtcgcaacaaaccaccccgttaacgttatcgatcatatgagttgggaacaatagggacttacatccgaatccactgcttggagcttgaacatctttttgacccaaaatctgacttgtttagcaaggcaattgattgaatcaaagagatcccataccgaaattgggccgattccactgccgtgtctttggggtcaatcaatacagttctgatgttacgggcccttttagcgtatatcaacgctttatcttgcttcttgatggacaggtcctcaacgtagctagagtaaggaaatattagccctgactgcttttcggtttatcaagaaccactcacttctgcatcagttgatcaaactccttcacatcagggaagccgctaagtgcaggcaccacagcctctgacaacaatgtagcctcgttgtgagactcttggttttcaatctctgtttcaccaagcgggtcgcggggcagataccttggccgttgaaggtagcgcgattgggacatgaactgcggcggatggtgtagccgggggtcatctggggttgtcatcgatggaatcgaaggttccgacgtatattgcaaatgctgcaaccccggagacagactcgactgtgggccatagggctgcccaaactgagacccgtacgggctgaaggaatgctgagggaaatgatatgaagcagaaccatgggtgttgaagtcatggctttcttgcttgaagtcatggctctctggctggccgtaggagccaggcactgccatttggtgattcatgagatacgcatcattaccttcgttgcgccttgcaaagctgctcataatgccttgctgggtgggaataccgattgattatcagttcaggccgatctgtttcaaacagatagatgaagaataagataaacaaagagatatatagaggaaaaaaaaaaaaaaaagggcagtatacagcgagtctccgagtgaggtgatgataatgaagaaacgaagactggggttaactcgtttgcatatagaggaagaattgccacagtatcctggtacaccacagccagtatcacccaaaaaagaaaagaaaagggaattggactgtgtctagaagatcactggaagtgagagatagagagagaaggaataattcacagaaagttgatctagaaacggggtagcaattctattaagaagaccccaatggacaaacagtgcaggactgacatggctgatgcccaagatgaagtgcacgagaccatgtcgcgccagagggcagagacaacagagggcatccctggaagacgaacagcaaatattccacagagaaaaaagaaatgatggagccaggcgagtcgaagctctgtaaggtacggaagcataggtattaccaaagctttgcagggaagatagcggcatctaaccagaaaaaaagaaaagaaaagcagcaagaaaggactggggttcgtggtcaagattctttccgacccgccgaaggtatcgaaaggtggaagcaggctgatacgacagcgcacgggagctaatggtgatacggattcctgcctttgccttttcaccctgaagtcacccatttgcttcaaggagcccacgttgaggatatggaagacagggctattcgaggcaccctatcggagacagtgatgacttttggagggggggaagccccattcggctctcctgatttgaccgaagtacagcggggggcgaaatcatcatctccccgaattttcctatacttagagcggaacaactctatgggatcttcccgactcgaggaaaaggggaactctttgtccctgcacgtttgcttcgtcaaacaaagtcggcaggagattcggcaaaaaggaatttgtccatgcaagtagccgtgcaaattggtaaggaacatggattgaggatccccttgaagttctgcatcttcaagctgctccccgtttgagaagaggagaaggggaaagaaaggagagagaacgggggtcatcaatatgtgtacaagggcaattgatccctcgagattggaagttttcctagggaaatccctgttatgtcaatgttgtactgccatgccgtcccaccttttatttttatttttttattcttctaatttcccagagatgcaagtgaaaagattttcgattttcgattttcgatttgacgtggcatttacttaggccaagacttggacttttgaaaggaaaaagaaaaaagaaaaaagaaaaagtaaaggacggagaagtacaggggaagaggaagtagacgggatgacaggatgacacacgtttggttgaccggacaggtgagacaaaagttcggaaacattatctggtgtgacggtacttttccgagatttagtatatttggtatttttcattttatacaggttgtatactatatatatatatatatgctctatatttatattataatattcatgctttatgtagtgtattagtacgaagtactcaacaatatagttacattcttcaaaccggaatcatcacaggtcttcacatcgtaagttcataggttagttgtacacacgggtactgggaggaaaaaaaaaaaaaagaaaggtatgcagacagtatgcaggcggtatgcagacgtcaaatctgttctatgccgatccccggtcaaaggccactaaatcgcggatgatccatttccaatgactttggtcttgatcgcctcgatcgaatacccatttgtcaaccttgcgtctccacttgtcttcctcagcccgctggcgtcgaatgaattcggggccgacatcaaattcctccgtcataggtccttcgtcagacgattcaccggcactcgcatcgtcccctgctgggaattgctggtcctcaatcgctccagaatttcgtccattcatggggattttgtcatccaagtcgtccaggccggcaaaaacgtcgtcttcgtctcccatagatgctctgagccaacacatccgatgtggatcaaagaccatcccaccaacggtctggacattctgcatcgcgccaacgttggtgatgagagccggtgccggtttaggtgatttgggagcggtgtcaaattcctgaaccaggttttcgtttccttcccatcggaaattaatagggttgtagcgcatacccctcacagctggaaaacggttaatgagattgtgggctttttttttaaaaaaaagaaaagggcaaataggggtcttgcttacatttggcatcctgcactccagatcccatgggcttgattaagtgtggcttggatgtcgacttggcattcggtttacctttccggcttctgatcgttgcagacgccgggggaatcctcgagataggctgggacttccagtttgagttgaacgtcgaaagaggattcggttcacggcctttggagttaatagccatggaggcaatgcgttgttccctggcatttctagatgcatttgtatctcgcgcaaacctaggtgtcgggctgcgcaatttggaggttgatggagacgtgtaagattgaggtgattcatcgggttcaatccggctctggctgagtctggcgcggaccgaccttggagcccctcgaccggtgggggttttgacaaacttgctctctgccaagaccgacgtagataggtcatcaaacgactccagctctgttccatccccgaaattgcgtcttttagtgggtcgtgtgattgtacgttttgtagaggaaccgagagattccgcgcttgtgtcgccaaacccagcacggagcggctcattgcgagttggacgggagagtcgagagactgtgccctgcggactaagaagcccgccggagctatctgaattggtgcgacgtgacgagcgataccccttcacactggcatggtgtgattgggattctgatacaccagccggcataaatggcacctgaggcctgcggcccagcgacctcgcatcggttgttgggagatccacgggtgttttgggcctggcagacggaaggcgggctgaacgatccgggagtcgttgggaagcggtcattgaggcggtcgagcctaggccacgaatggatggcagggatcgcttggtcttcagacgcctaactggagtgttaccctcgtcggcctgggcaatgtcccgggaattgcgagacccgagaaaccgtcgactagagagtgtaggagtcggcgatgtcggattagcgatagggcccgggagacttgaagttgacgactgagaagagtgccctagacgcgattgtgatgttcgaaatttggagagaggcgcaccactttctgacacagtctcaaggtgggttgaatgtgtccggtcatgaccagacaagcgcgggatacgagttcgtggagatcccgtcgcactggtgaacgtgagtgtcgttgcagatcgacgggccgggctggatggcctttctgttttgcactttatgttgggattcagagcgggttttccaaaggagaaagccttctcattgtcgatatcaataccagaaaagaagtcgtcagcatcagaaggaacatgatccgcctgactttcttccgcctcgacattctcggcttgggcagtttgtcgcttttggagagaagcactgaaatcaaggggaccttcgggaatgacgataccgtcgaggccatcgtcttcactttccgcagtgagacagcttgacacgctggggctggcgatggagatggaagaactgggcactgaacgaccatcccttgtggtaccaccaactcgtacaccgatacttccttcagaccactcaagatcaaagtcctccaaagtgggactggaaacgtagaaatttgcttttcgatgggataattcgagaggctcgtgattagcgggaagttcaaaatcctggttgaagtcgtcttccgtctcctgttcaatgttgaagccactgccgacattgccaatgttcaatttcttcggagaccgaggagttggcgctttgagggttgggatatctcgagttcccaaactatcattgtcatcttgaaatgtgtccaatggtcccaagttaggttgcaaacgtgtcgggaattcgtcatcccaagatggggacgccgtggatttcactggactggtagcagcagagctcaaatttcgaagggagtcgggaaacatagtttcccgaggagttttgagctgtaacagggtttcaggacccgggagctcaacatcttctgaccagtcatcaacaaaagtctgcttggtctttcgagttgacaagcgcttgatcgtgcccccaataagagctgacttggggatatttggaggaatgggaatgcccgcagtcttggcggaagcaatggcatcttcttttgcgaattcatcattatcatagagtggtacctgccagtcttcgtcgcccgcattagaatcaatatctgagcgagcagagcgtctggaggagatagaatctcggtgcccagaaggccgaaatgacgagtttgttatggacccagcgctggatgcggtgcgaaagtgaatatcctcactgaactgcaagtcgtcgtcatcatcccagcattcaatcggctcgtcggtacccggtcgtaggtggattggtaaagattccatgatcggcgaagcgaattgatcgaaggggtacagataacacagtggacatggaattattatagacgtccggaagcgggtgtgattaagtggcagactcagtgttttgcgacactggtgagggttcagggggtgcggacatgagcgtcattccgtgtcggttggtagggacgacagataggagcaagtgagaagcacggcttgactgttgatcgtagcgtgacgagtgagctcgaatattgcaaggcgtgttgttagagaaatcagcctaatgaaggccggtgctctagagccgatttccccgaacgagaccaagcgggttcacaaggcgacctgataaatgccaggtcctcatccataaacattcactaggtagaggacacttaggatcggggacactcctaggcacttgattcccactgctaatctttgggggaattcaaggaacttaattgcaagaacgaagagacaggggaaaaataaggcgtgtcggttgtggctggatctcaaattcctcgtggaggagaggaagaacgtgacagatccccgtattggtaaagtttcaagccagtaagataataatgtaataattttaccaggatattcggtgcagatgtggagactgcatatttccaagtgtgcaggacgtattttacagccatttcatgtaattaacagaacggtgatgtcctcggtatttaacgtttgtacttatatggtcatattgaatgtcaatttgatgtttgaagctgtcaaggtaaaattatctaactacattatgtacatatgtaatctgcaagatacagtttcatatcgattttaatagctatatatggatggtaatcagaattgtattccaaggtcaagtaaccaccggctgtacttccgtacatttcacacccttggagtggtatctgataccttcgacggtacttctccactcgagttctgcctagataacttttccttaaatacatatgtatccattctaaatatctcacttcctaagagctcctaccctatccttctcatctgagccttcattccaaatatgccatctcctgtttcaacggaacctcgaatcttgcgatttcccagatctgacgagactggggcttttgtactcgtccatgtctggtgtactggccctgctccactcgatctgagcctgacagctactgagggggagtcgccctatgttagcttgggtgcgtcatcaccgaatgaagtttgggaattatgagctcatgttgcgcagtgaaacaaactcgcttgaaagatcttcaagcaaagaattacgaaggatcccatgatgagtgggttaaaacagtctctctcattctaggacaatcttcagctcctcccgatgaaccagattgggccactggtctcgaagcttcggccagtatatcgggttctgatgaagacaaggcaattgtgatcacgatacggaaacgagtgcagactatcacagttagtgtttcatgccggtggcttatattgtatatatcacgactaaccctaatatagcaacgccttggtgcttttaccctgaggcaggacgatgaacaagctgtcgagctttttgaatggacaggaatcactgcggctagagctcatgtgctagagcaacaagtatccagcctgactggccgttatcgccttgctgaggacaccatacataggttgaatgaacagcttgaggagctcatgcatgcaaaaactgagcatgagaatcgactggtggccaattttgtgcagatcttgaacgagaaaaagcttaagatacgcaaccagcaacgtcttctggcatcagctactgtggatgccacaaaaggcaggtgacacaaacagagaaacctggatgtcttgactgactagatatcgacagtctccgagatacaagctagtattcccgaagagtcacatgggactgccaagaaatctcattcagctaagagaagtgccagcaacatgagcgacatagatgactctgatgggtttgaacaaatggatattgatccaataaaggctgatcgaggtgccaccaataaccaaggcaccgatgacgaagagcgtttgactcatcccttagacgacgaacaaaataatagcacgacggacgacgattcgtctcaggatgaacttacccagctgaagcgagtctccccagtgagggacaccgcgccgcctcaaagagatttgccatttgctaaaaggactggtggccctatcaagactgctccaatccagcccagcgaagatgccgaagaaaccgcgggagagacagacgatgatgagctctaaattgaccacctggagcaaattagacaaagtaattcaacagagcgagatacaattccatcttatgtgcagaaaaggcacccaattgacgcagcagttaaagagttccttttgactccttgatcttgcaatacaaaatatagacgtatcccccgttttgttcctcctctgccctgttctagtcgttgggacaattatttgttcccagaagtcatttctcctggtataatttcacttcgtctgtaccatagaccctcaactatactttccattcaagagctgctacgcacgaaattacgaaagtagcccagattcatcatctccgacgcccatggactcgaaattttgggggttcagtcttttatgtacaaggcaaccactaccgattaatcccaggcgacaccggagaatggcgaagaggtcaacaggaaccggaaggggaaaaacacagaagatggaaaggaaacagtacatcaagaggaaaatttaagctgtggtacaataaaaacgcctgcaaccattagagaaacacagaatgaggtcaaaatagaccccgatctaaccatacaaagcctgaggagacatttctcctgcggccatgaagttggtctcagggtttccagtggccttggcagcggaggcgcgggccatggtgggcgaactaaatcagagttagcaatgcaaataaattaatgataaatagggtactcaccttctggagatagcgtcagtgaagaagaagtcttcgatcaccttcttgaaaggagccccggtggcttgagatcccttgttctgatccacaagttggaccttgctcaacgagccaaccgaggtcggctcaacaacgtcatagcggcgcatgacagggctgatctcctccatgcggtcgcgaagagcctcgatatcatcataaggaagaggagcaccgaggaattcgctagtggcacggatgatcttccagtcgtcacgagctgcaccgggaagagaagtggcagcacgcgtaacttgcacgcgaccttctgtgttgatgtatgtacctgacttctcggtgtacgcagcgccggggagaacgacatcagcaagttgggcaccgcgatcaccatggtgtccctggtagacgacaaacgcatccttcgggatctcgctttgggcaatctcatctgcacccaaaagccacattatcttgggggtagtttgagcaacctgggtagacggcgcagtgaagccaacttcataggcaccagcccgagacgccgcacgctggaggacgttatagccctgccactccggggtaatgaagttgcttgcattcttctcgacgaaaccaccgacagcctcgaagattgccttagcatcagggtgctctgcagcagcgctaccgacaataatcattggccgtttggctccggcaagcttcttgccaaattctccggacaaggaggatttcaaggaagagacatcagtacccaaatggttgaagtcaaatgtgctctcaaactcctcgccgacaagtccaatctcaagatcagatctaatatactgctttcggatacgggcgttcagaacagcggcttcgtgacgagggtttgttgcaaccaaaaggattgcatctgcctcctcgattccatagatcttggaattgaaaagataattggaacggacatcgataccgtgagcaatgggggcaccacctccaggttgatccagggcaaggttgtcagagccaagcttgtttgccaggtccttcatggcaacgagcgactcagcatcaaccaagtgtcctgcaacagccttgaactcatttgcttgtggctgcagcttctcgtgggccgacgagatctccgttagagcctgttcccaagtggcagggacgaatttaccctcccgacgaatgagcggcgttgtgagtcgttgggtcttcaacccatcgcatgcgaaccgcgatttgtcattgatccattcctcattaatatcgtcattcaatcgggggacaacccgcatcacttccaggcctctgctatcaatgcggatgttagagccgagagcgtcaaggacatcgatcgattcggtgtgcttgagctcccatgggcgcgcccggaaagcatagggcttcgaagttagtgcaccgacagggcaaaggtcaatgacattgcctgaaagttctgagttgaggttctgctcaaggtaggttccaatctgcatgtcgtttccgcgaccggcagttcctagttctggggcgccggcgacatcattcatgaatcggacacaacgggtgcagtgaatgcatcgattcattgaggtcttgaccagtgggccaatgttcttatcctccacggcacgctttccgccggtttcatggaatcgaccccgatcggcaccgtaacgcatcgactggtcttggagatcacactctcctccttggtcgcagacaggacaatcgaggggatggttggcgaggaggaactccatgacaccctctcttgccttgtgaaccagtggtgagttcgtcttgaccaccatgccgggttgcacgggccaagcacaggaggccaccggctttggggcacgttcgacttcgacgaggcacatacgacctacagtatcggtaagtacatatgcctcaatggtgtgggatgggggattgtgggtttcacatacagtttcctgcaaccagaagttttctttaggggactaatgtcagcaaaaaacaatgtgtgactcgattaaaggcacatactcatggtaacaatatctggtgcgtgttagtactgcaggtcaattgtattggtgaggtcttgtcatacctgggaaccgttgcgcctgcctgctcacaggcctggataagagccgagccagctttggggagagactgtgagtgaaggttcaatgggttacctcgagtgattatttaccttctactgacacctttttgccatctagagaaatgagccatcagttatcgatcaattttgattgagtagaccaagattggacttaccaatggtgagttccacctcggccgcgcgaggggctgtcgtcgcgaatgcccggggggtgaccttaggaacccggagggaccgggcggccgcacgaaacagctgcggccgcatcattggaaggagaacagagatgtgagggtgggagataaggtggaggatggcgaggggttgagatcctggtgacggttgggagttcagagagcactttgcatcggaatctgcggttctaaggttacataatgggactgctgaccatcacattgctgactaagggaaacggcaaatgggctcacggggattggctagattgactcggttaggcggataaacttccgctccgggattccttaaaagccaccgtttctgccccccttattttccttttcctttcttcaatttaaattgttgacgggcatcatttattgtaggaggcaggccatttccctgttcctatttcctctacagcatgtcccaagagcagaattgcaccgtagctggagctgtcaaaggttcgcctaatgatgactttgttccttaccaacggtagctacatcattttcctaatatatatagtttcgtacatctatcaatataatcctctattcatcctgtacattattcaccgtatacattccgcggtttactcaagatgttgctagatcacatctattgaaacttcggtggcaatgatctagactctggtgtatcctatatgcaaccaaagtacatctctatgccctgcgcatcctaggcagtatacacacaacaagaggaaaagatagtaacgaaaaagctcttccaagcaacacctcgctactatgagatatcatacaccgaactaataaaatacaaatgctaggctgcagcttgagaatcactaacctgccaagtggattcttgcttggtgcctggtaaccaagtacgggaaacactggcccctcttggtcgaacatggccgggccgatcgtcttccttcttggagttgtttgccgcagcatggaagttgttgggggcaccttcaaaggccctccccgcagggaaagcataaccattagaatcccatggcttgcttgagtgccgaacattcattggaagaatggactgttcgccacggaaatgatccgtgtttgccctttggtcagctacatcatcatggctattgcgatcataaaggtagaggccaacgaaagtgaggccaataccaaatgcttgaatcgaggtggtcgagctcccaaaccatataatcgccaccacgatcacaaaaacacgcttgaccaatgatgcaaccgaataggacacaggagaaaccattgacagcaacacaaaggccaggatgttttgggcaaagtgtgagagtccattaaacacaaactcaagagaaagagcaccgtgatccaatgagccttgcttacccgatagcgatatcgcaccatcatggatgaaatcagatactagtgggtaaccctcgctgacaaaccaaataggcagagtgaggaaaaacgccaacccggagcaatagcaaagcaagttgagtttgtccaacttccgccgtccgggggtttgcagatctgattctgcacggtctgcctcgttaaacagcttcttcgagaatatgttctgcgagacaaagacaagagctgcaccaaatgcgcaaaagataccgaagaaattggtagacactccggtcgagcacgcaagcatcacacccagagtcagagggatcagggataagtaggttgcccgggcatatcgaatgcggaacaggatccggtatgctagaactgtgaagaggggcgaaaggcccttgattgtgtggaccaaagatacggggatttgttcagtagccatagagcttagaatgtgaccggccaattggaataccgccagaggcaaggctgtggaaatcacgtcgcgggatgggtagcgaattccatgttggaggaccggaatactttgtcgtaaccgaggtataatcgtggaaagatacaccaacagcaagcaccaaaaggagacaaacgcaaattgaatcatcgtcaatgtgattggcatgggaagagcattcaaaatcgatttggaagatgtatttgtgagggcagaggtcaggtaccagacgacacagagagccttgaaacagtgtgttagcagcctcactaaatgaatttcttctatatttgaatttctcaaagcgctaattcaacatacagtgagtcggtaagagactggggcgcgaagtgcttgggccaattcatgagcattggcactcatactgccattgcgtgttctgattgtcgtgatggcttcgctgatgctctttcgcggacgatgtttgggatttcgtaacgatccgttcccatactctcgcgagtaaaagcttgcttttctcggttcccagagctcgttcggggcatatttcaccgaggcgcttcggtttggccgagctgaccccgcgacggcgtcgagggtgtcttcgtaaggcggaaatttgtctatcgggctgttcgttgattgaggaacggaggatttggtagggatttgcaattcggcctggcgcattgaggcgcgtcgcccatgaccggttactgtagttgtagccatcttcagagacgtcaattccccggaccccgaaaagaacccacacttggtgtcacttacccgaaaagggcgagaaagcagctgcggagaggcaatccgctcaatggtttccggcgaggatatgtgtccgcttcactaattatcggaggaaaaagggcgggttggttcgccggtttgtcgttgtcgatgacgaatctccttgagcgaatgagcgtcgagtatagaaacacacccgtggacacgctttcggcgaagccaagtgatggaaacaatatgtgaatatacctagtgatgcataggcatatgttagacaaaggaatggggaaatatatgagaaagatgtccccataataacttgtaacgcgaccaaggatatgcaacttgattttccaggtacggagtaccgccacttacattacgggatacgaagttcatgttgatgatgaccgaggaagtctagagtagccacaagtacagatggatgatattattcctattgcatttctactgtgtattctttttttttcctttctatatcatccttgtgtttcctataataagaaaaatgtctcttgttccgtcttcgtatgccctcttctccattacgcgtcacctgggtcacgtggtatggaccctgatctgcatgcaaatgtcttggctttgggagttcggacagggaacattttgatatacatgtacttatgcaggtccttgacgacgtaggactataataatctgatctatttggctcaagatgatattaggtacgttgtaagagacaaaataatgtttcccatccttctcagtatgaaagtacgaaatgagtctcagatgcagaatcctgtaaaatcccacaaagcaccttttctatgtattaatagcatataacctaggaagcttttccatgtatataagctttcaatgacatgtagatcttgaatctataggtatcaacatttgaacataagtgaagatgcacatacataatgtatgtaccccatattccagagctatactcctcagacatatatggattgtatccatccatggatgagactcttggaatgttcatgactatgcctaatcaagtagtccacaagaacatgaccggaacatgtgtatagggaaggttctcagggttctcttctcactctgctccttccttgacttgtttcctttcctcctttcctccttttatctctatctctctccttccatctcatttcttctcacatcccaatctcgtctcttctcatcacttctttatctccaaaagttcccttatgtttactgtgatctcccaagaatctgctcggaatccttttcgttgcatgtaagctcacttggtttccaacgagcctgtttgtcccaaccttcacgcagcgactccatttgctttttttttcgcctctcttcttttctgtttctatcttgtttctgcttcacttttaatctcttccagttgacaacatgtctaccctaagcggaccttcaccacttggtcgaatggggaatggaggccgttttacctccaatgatgccattgatgtgcgaaatctttcttttggacgtgaatcctcggtatgcttctcgggaaacaatcttgaatcaaattcctagcatactaaccaccttggtcgcggcagagccctcagaactccattactcattacggttcttccgatgcggctgaaacatcccgacatgaaaagttgcaggctttgtctggtgaagggactgaacactcggctagcaaggtatgtgtttcctacggtatcgattcacatgtgtatgtgcctgtgatctcacaatcccagaagcagaagctagatcatatcaaagttgaacctttgaatggacaaacatcggatcttgacagaatactggcaaagatttctcccaaaacaatccccccttcacgttccgaaaccgatcactcttctgtttcgtctcagatcgctcccaccacgtcggtaccatctttaacccccaatgagacaaccaatccttacccccaggaagacagaacggtagagctacttcgccttaagcaggaactccttgctgcaaattccaagattgccctgcaggagcaagagcttgctcaaacccgcgtgataaaacataccttggatcaagcccttggcccgtcatcagaggccgatttcggcagccgcgaaattacagaacagaccattagccacctacagaatgcttttaatgcatcgagctctgcatttactcagtttcaagatgcatgggctgtccaagatgattcgcaatctgatgtctcggatcctttgtctacaggagcttacaacagatcccgcgcactctgggcccagaatgagactgctacagacagagaatacggagagagcctttcaggctctagcagctctacaagccaggacccaaatcggttctggggagtctccagcatgtatccttcgtttgctggcccaccgtctctgcaatcgcaaagaccacactcggggtcctcacctagttcatgtggattttacccacgtcccattggtgagcaaatgttgtatcccccagggcccctcaccggggctcgtcgttccatcgctcaaaacagtaggggcggatctctatttccaattcagtctaccccttggggtgaatttgcttctgggtcctccagtgagcagaccaccaagtcacctgcttcgccgaagagaccccccagcgcttttcagcaggtcggactttactcagtgcccccttacccccctcgaccgattggaagccctctctcacccactgccacagagttcacaggtgccaacacgaatgaaaccacatgggccaactcggtaagcgataacaatatgtgtactgtttacattcattctaactcttgtcagatgagcggaaattccatccagacatacgtgtcgccactggaaccactcaactatcgacgcctactcgacaagaatgtgtcgtgtgattggaagtacattgtagacaagatcatctgcaacaatgaccaacaagcttcaattttcttacaacaaaagctcaaggtcggcacaactgagcagaaatacgacattatcgagtcaattgtgcgtcaagcctacccactcatggtcaatcgctttggaaacttcctcatacaacgctgctttgaacatggtactccggagcaagtcatcgccatcgcaaatgcgatcagaggcaacacgctaaacctcagtatggatgcatttggctgccatgtggtccaaaaggcatttgactgcgtttcagaggagcataaagctatgatggtacatgaacttctccgcagaattccggagacggtggtccatcgatatgcgtgtcacgtttggcagaaactctttgagctccggtggagtggtgagcctccgcaagtgatggcaagagtaaacgaggcattacgtggaatgtggcacgaggttgcccttggagagacaggaagtctggtcgtccaaaacatcttcgagaattgcgtggaggaggaaaaggtaagattccctgccaacctgacgcgctaccatacgcatccaacccctttttcgctgccctgcttttctgtcggttccttgtattgattataccaatactaaccatctttgaagcgaccagcaatcgaggaagtactggcgaagatcgatgtacttgctcatggtcaattcgggaactggtgcatccaacacatctgcgagcacggtgctccccacgacaagagccgcgctgttgagcatgtccttcgctgggctgtggattacagcatggatcagttcgcatctaagattgtggaaaaatgtctcaagattggcggcaccgagtttatggatcattatctctctcgtgtctgcactggccggtctgaccggcctcgcatgccattgatcgacagtaagttgcccgggctttaacatcatgagaaatattaattcgttctttagtagcgggtgaccagtacgggaactatctcatccaatggattttgatgaacgccgcgcctcatcaacgagagctggtggccagccacattaggtattgctccctgacagtccattatctacttggtgtggtctgaagtctaacctgattcaactaggaaacatatggtctctcttcgtggctccaaatttggctctcgcgtggccatgctttgctgcaacccgtctcacgctacacggcccggtcctggggctggaatgcaaatcggccgtttcaacagctttaacgaagacaaattcaccaccacgggcccgtccagtggtcgtttcggtcgtggacatcaatggggaccccattatgcgccacttcgttgagcctgtgtcactgtgtcttaatttgatacgtcatattcatttttatcgccatgcaaaggaaaaaaataaaaataaaaagataaaaagaggaaaaggaaaaccgacaatcaaccgacaatcaacaactaggaaaaagcatcttttgagcatttcattccctctgcttccaagcagacagtctgtctttgccagtttgcctgaccgtgtcttatcaatatctgttgacccaatcatttccgtgtttcaatattgcgagttatcactgcttgccgatttattcatttggcttgctatccccagtggctatcattttattcaatctcatagattgaagcttggggcgtgtcacgttagttttctttaaaaccacatgttattattcagattctattccaatcaaatatataatccatcatgaaacttatgtggatagaacataatttcagggagcagcacccgcagtctcatcggatgcagtcatcacttcatccttctcccagggtttccgtcgccgtggtttctcactggaaatatcatggccactaagcactgtgtccgggatgtcttggatcccaggtattggctgccccgtagtgatgagttccacaatgtgcgcgaacgacgaagggtaagcaggttcaggatgcgctgatctctcagtcccagatgtgcttgggtctaatgcttcggagatttgcaagtctgtattgcctagcccatggggctccgttgtccgtgatgctaaccatgatttgaaggcagcaaaatcaatagcaggagtgagcttttcttttctgtactcggattagtacccgacgtattgtgtgaagtgtattcccagcataccgggagaaaaagaaacactttgcttgcaggacgaggtcgtcatcccggttcatctccacctcggtggcgggggtgttgggatggccaagtataattgagaggccatttgcaaactcgggatccgatacgaaggagtaagattgtagcctttcgaagacctgagtttctgagggctgcgccattatttgatgattcttagaatacagaaaaggtctgggatgcggaggatgcggaggatgcgtggggcagcctaagctaactagccgaggctcgtctgctctggtgcgttctccaagttctctactctgcaccctttgacgctttggggcctttatctactcatcccgaaaatcggggaagttacatggcacttgcgagaaaattcgtattttgtatatacagacgcctttccctcccatgctaccttttggcctgtgaacagaaaaatccagggatatcttgcgccgccaaacaatgcaatattgagataattccacgccctagaccatggtatccactccacctgacgtttggctgcgtgccccagagtgcagggggttacttctactttgacagccaggacagttgtgcacgacctcgtgggcaaagagatcgcagtcgatacaaaagtggttatggcacgcggtacactcgtagcgactgctcacactcatccccttggtctggttctctgccgtttgccagtgatcttccggaggcacggatggaaaagaaagaccacaggcaaagcaagcggagcttcgcgaggctcgacgccacggcacctcgacccagttgatcaagggaaatagatgatgatacgatcgtgccagatgagtcgaaaggatcaatgtgagcccacaagatgggcattcagcaggaagactacacactttgctgttgcatcgcgagcaaagatagcctcctcgtgagggctttgaatggcatgcgcagagtgagggactggactccaccgtacgagaagggaaccccatcatcagcaacgagcttgcagattctttctgtgagtaggccgctgggggtgtagtcacgtccatcatcagctcccgaaagtgctgctcgttcaatgctactccatatgctgtttcatcaccaccgttggtttttgtacacagttcccggcaaattgcaacctgggctccgagacccacgataccaacccgaatcttgtcgctaatgagcgtgtctatcgttcggtggatgtccccaggatcagaggaaagaagggaaccatatataaacagcacttctcgagtgccatggctaggcgtatggctgaattcactggttagtttcgttacttatagcgggtgtaaagaagacatacaaaagagcacctcgtgccatctccaacccattctgaagactaggcaaacctttcggatcttgtgttttgagggtttggatggctgtgaggtgttctgttggattgccactcatggcactgactcggagcgcgagaccgtctctcaggccgaggacaccaagctgcgagatgggattttgttcaaaaaattccctcacgaattcctgggcatatcggagagtcaacaagtatctcgtgggtcgcaagtccttctcggacatggattgtgaaagatccagaattaggatgagatgtcgaatgataccgcgctgtagtggtgtcgtatctttcaggagcctggacgaacgatataatttagcaagaatggacagacactgtaagggaaacgaactgaccgtttccgttttccggcctccagcagaccttcgacggtcgagtttatggtaccatctgcaccctccactagtgtctcccaggttctggatagctcccattctgcgcccccgcgctgctttcttctggctcgcgaattatcgccccgagtcacctgtaaatcatcttcatcttccgttacctcccccacatattcttcgtcggagtcggccatgtccttagataagagtggagagagagagagagagagagagatgatccatgcggaagaccgaaaatgggtccaagcttccgacggagctccgttggagaatatcctccctatctcctttttcaccaagtcacaactctcaatcacttcaaaactaagctttttttttttttttttgacatagctccgacgatagccgtagacggttaagctagaatatctccccccgatgtggggaagaagatccattcgtgctggcgtagcagttcaagtcgtccgtccagtcactgtccgccctacccctcctcttctttctcgcacactacacaaactttctctcccgcattctcctcgactgcgacctcgactgcctaaacccctcgctacattagacctgagattccctcccattaggcattgttccgccgaagtccgcatgatggcgtctcaagagcgagagacacttcctgacgtgtgagtgatgccccgcttgggtcattctggttattctttccctttttgcttcgtttttgcttcccaaatttgagcccatatctgctttctggtttgcagcattaaaaattgacatagcaatagggctaagcctgtcaactaccatgtctctcttttcgacttgcagttcggtggttcgtgggaatacaagggcgcgttgaagatcgatctcaaagtcacccgtgctaccagcgagattgtgctgaactcgaaggagatcgaagtacaaagtgctgaggtattggggaaagatggtaagtgcgggagcacatcatcagtgtgatatagaaaaggaagaagactaatacccgtcttcctttcatagggagccagttggccaaagcatccggaatcacctacgacaagcaatcggagcgagtttccctcgctttctcgcaagagattgcgccggcagacgttgtgctctctatcaactttacgggcaccatgaacaatgccatggccgggttctaccgctccaagtataagccagtcggagagccctctgccgacacccccaaggaggacgacttttactacatgctaagcactcaatttgagtcctgtgatgcacgaagggctttcccttgtttcgatgagccaaacttgaaatccactttcgatttcgagattgaagtccccaagggacagaccgcactgagcaacatgcccgttcaatccgaaagggacggacacaagcccggtctgaagtttgtcacgttcgagaagacaccggtgatgagcacctatcttctggcctgggcagttggtgacttcgaatacgtcgaggctatgaccgagcgcaaataccagggcaagagtattcccgtccgagtttacaccacgcgtggccttcaagaccaggctcgctttgcactggaatgtgctcaccgcacggttgactatttctcggaagttttcgagattgaataccctcttcccaaggctgatctcctggctgttcacgagtttgtgagtaaccatttatcccctacgaattccaagcttttcatttgagctaatcgcgggtctctaggccatgggtgccatggagaactggggtcttgtgacctatcggacgaccgctgttctgttcgacgaaggaaagtcggacaatcgctataagaaccgcattgcttatgttgtagctcacggtcagtccccacgtcgatctttaggtatccatgtttcaagatggctttgatatctgactcatgttgtagagctggctcaccagtggttcggcaaccttgttaccatggactggtggaatgagttatggctgaatgagggattcgcaacttgggtcggttggcttgccgttgatcatttctatcctggtgagctttgttcgcttctggccgatgagtctgtgacgcagtatctaatgtgcaagcagaatggaacgtctggtctcagtttgtcgtacggaatgcccgaggtaatacacatcctgataagaccaatattgacgttctcccaggctgaaggtgtgcaacaagcatttcacctcgactcgctccgcgcttcccaccctatcgaagttcccgttcggaatgcgctcgaagtcgaccagattttcgaccatatcagctacctgaaggggagctctgtcattcgcatgctgagtgtccacctcggcagagagactttcttgcgtggagttgcggattatctcaaatctcatgcatatggtagggcgtcaaagaagaagattttgaggaatatatgttgagtaattacaggaaatgcgaccacaaatgacctgtggtccgccttgagcaaagcctccggccaggatgtgcattctttcatggtaagtagatactcgccccttggctgtttctttaactctctatttggtcagctcgatatctaactgatctgtcctaggacccctggattcgcaagatcggtttcccggtcgtcaccgtggcagaggagcccggtcagattaccgttagccagagtcgattcttgtctaccggggatgtgaaaccagaggaggatgagacgaaatggtgggtccctctcggcatcaaatccggagcgaaactggctactgttgacaaccgtgctctaacctcgaaatccgacaccgtcggaggggttggagaggacactttctacaaaatcaacaaggacctgtctgggttctaccgaaccaactatcctcccgggcatctggcaaagctgggccaatcgcttgatctcctaagcaccgaggacaagattggtttgctaggtgatgcagctgctcttgcagtctctggcgaaggcactacgcccgccttgttgactcttctggaaggattcaaggaggaacaaaattatctgtaagcaacatctccttatggtattttgctgtcatttctaacgtctcatcctgcagtgtttggtcccaagtctctgcgtctctggcgaacatccgctcggttttctcacaaaacgagaaagtggccgaaggattgaagcagtttactcttaaactggcttccccggccgcagaacggactggttgggagttcaagcccggcgaggactatctcattgtacagcttcggaagctgctcattggaatggtctgtaatgcaggtcatgaagggtgagctcttttcccttgtgtccgaatgctgttgaacactctctaacacaatctccatattttatagatttgtctcagaggccaagcgccgctttgatctctgggcgaccgggaaagacaccagtgctatccatactaatctacggtcagtgattttcagcgtcaacgtatccgagggcggccgtaaggaatacgatgctgttaaggaagagtacatccgaacggactctgtggacggcaaagagatttgcctgtctgcacttggacgcacgaaggatgctgctctggtgaaggactacttggactttgtgttttcggataaggtggctatccaggacatccacagcggagccgtatctctggccgccaactcgaaggtccggcatttgctatggcaatacatcaaggacaactggactgctgttgaaacacgattgtcatttaacaacgttgtgtttgagcgctttgtccgtatgggtctatcaaagtttgccgatcaccagatcagtgacgagattgcgaccttcttcaaggacaaggaaacgggtgcctatgaccgtgcactcgtgattgtctccgacaacattcgaactaatgcatcctataaggagcgtgaggaggcgctggttcttgaatggctgcaggcacacggttacgcataaatgcgcatctacgaacatgtggctttatgtttttctttctttctttttctcttccttctttcaacagtatatttgttcaacctgaattccttgctttagatataatgtaaaaaggtcattggtctagtatccacgaggctgagtttatgcacgggataacatcagttgagcaggtgatctcggagatgtgacgaggattcaagtatagaatgacccctgtgataaatatatttcgtaaaaagccgactaaaaattaagaagaggcatgtatgtatagaaaataaggaaaacacagaaatcccgagaagtgccaggtggttgtgacgtgaaacaaagctgcgcatcaggtgcgtctgcctccctgcacctcctatcatttcaggcgactgttccatcattgtcccctcccccgacttcctaggaacttcgactccatcaacttcgttttttcgtttatattcctctggacttgtgtgtttctcttcagttttcatttcaccttctccgcctcccaaatctcatcatgaatcccgagtggtaagccttccccatttcctatccaccccccaaatgcccttctatgcgccctgatttggtcgactatatgagtctgcctgtgtgttgaatatgactgatgtgatattgatttctagagtaccgtcgcgtcgctgacttgaccgtcacacgacctaaatccccaaacttgccgatctccgttgcctaaccatcgagatagatacgattacctcttcaaactgctcctcatcggtgactccggtgttggaaagtcttgcttgctgcttcgtttcgctgatgatacctacaccgaaagctacatctcgacaatcggcgttgacttcgtacgtctcggaagttgcagagtattcaaccgcaacagaatagcggtgctgacaggtcatcatagaaaatccgcacaatcgagctcgatggcaagacggtgaaacttcagatcgtatggctatattgaacaccaactatttggagcaaagctaataatacatgcagtgggacaccgccggccaggagcgattccgtaccattacatcctcttactacaggggcgctcatggaatttgcgtggtttacgatgtcactgacatggattccttcaacaacgtgaagcagtggctccaggagattgaccgatatgctaccgagggtgttaacaagctgctcgttggaaacaagagcgatatggaggacaagaaggtcgtggaatacaccgttgccaaggtatgtctaaaggcaaacccagaaagcaccgttggggcagattattaacatgtcttgattgcacttttacaggagttcgccgacagcctcggaattcctttcctcgaaacttcggccaagaacgcgtccaatgtcgagcaggcattcttgacaatggcacgacagatcaaggaacgcatgggaacggccactgtcaacaacaagccgactgtgcaggttggccagggccaaggtgtccagtctggatcggcaggtggctgctgctaaacgacacgatgttctctttgtgtggtacggtgcttcactttggcgcaatgttacatcatgaattgaggggtttcaagcggcgtggtatctaatcggcagaagtcaggcttgtcaggcttgtcaggcctttggaaactcgacatgttcctgacgggcaaggaggagcttctgtacggagctggcaatcgttatgatgatgccgttgggggttctttcctgccttggatttgctttagacggcctgcgttctatcctcgttactgcgtttgcttatgcgattaccgccggtttctgcgttctcatgatttcctggccacgtctctgctctattaccttggcccatcattctctctgtgtctttctttccccctttcacctttctattttctattttctattttctatttcctattttcgctttttttttttttgtaggttggatttctcacttgtgaatggactaatagcgagaaccttgcgactcgaggcatactgcctcacacgaggctactttgtatcttctttttcggtaaatcagttcgttgtactatgtagatttcccgagtcaaatataaacgcatacatattcggatcccctatcaggacgtctaggacgatatataatcacatgcaagtcacaggcgccaactcctatactatagatcgttaacacatataatgaggatacctaggtagttcggagatattaccaatttcagtttactcgaatgtgacacattttaaggtcactttattaggatgcaggtaccgaggacctccataaacccaaccaaatccatcaaataatcttgtacaaggtgaatctacgctatgggcgtttcggaatgcagtggagttgccgaggcacacagcacttcggcaaaacgtcatgaacatcccatccccccttcaagccgacaaatcatctcgatggtcttaatgttttaaacgttctttacctcctgacatatttcatcttcttccgccctctacaggttataccttacacctgaacacagttcaataatccagctcttcccatcatgtctcaaccaggagccgagccaagcaaggcagcatctactgctgttcagcagagcgataacatcgcgcacgcgctggcgggtgcaggagggggggttctgtcgatggttttgacgtatgcttccccgcgttttccccatcgctgccgctaaccccatacccactccagataccctctgatcactttgtcgacaagagcccaagtcgagtcgaagcgtgcacactcaaccacccttgatgctgtacgccgcattgtacagagagaaggcatctcgggactatactccggcttggaatcagcgctgtttggaatcagcgtcaccaattttgtgtattattattggtatgaattcacgcgtgcggtctttgagaaggccgccatccagggaggccgagcctcgaaaaagcttacgacggtggagtctatgattgcgggtgccattgcagggagcgccacggtgctgattaccaacccgatctgggtcatcaacactcgcatgactgctcgcaaatctgaggcggaggaaacactgcctggtgccaagaaaccaaaggcatccaccctcagcaccctaatggacctgctccggcaggagggccccaaggccctatttgccggcgtcctcccagcattggtcctggtgattaacccaattctgcaatacaccattttcgagcaattgaaaaacgtggtagagcgccgccggcgtatgacgccgaaggatgcgttctacttgggcgcactgggaaagattatggccaccagcctcacctatccatatatcaccatcaagagccgagcgcatgtagccagcaaggatggccccaaggagagcttgaacggaagcctgaagaggataatccaggaagaaggctggaagggactctacaagggtaagcgaatcttgcgaagttacaccgggttgctattcactgacatatcttcaataaggtattgggcccaaggtcacccagagcgccatcactgctgcattcctttttgcgtttaaagatgtgctgtatgatatgatggtgtctgcccgtagaaagggccgcatcgctaaatagacaggaaatgatccccagtctgctagacctatgtgataactccaatggtcacattccttggagagacaaggctcggacgctcaattccaccatgcttgttcaagtgctcggaatgagagagtacgggctgacttccacttgcccactatagagaattgactttgggtgaaagttctgttctccgaagttcttggggagctcttgggaactcttttaaagcgatacccaggtgttctgcaaatatgtacatatgtagtttagttatttggaattcattcttatactccttttaatcataaaaaaaggtcccatacttcagacctgaccgcctttacgttgggttcaccgcccatcgccgctcatacccgcgttatcgcgttcttaatgttcttgacgcgattctgctccatttctccacacttcctgtgtcttctgcaaatctgggttcagttttctattcccctgctcctctgttactcaatacctctttgagcatctacacgtatttctgccaggtatgcttctctcggtccctttaggtgggacaactcctaatgcctgacagatccaagcgtgcctccaccgtcgaattgtcctatcgcctttgtgactctcatacccctgacttggaagattcgcgctcattacagatattgtcttttatacccctctagagacaatatcctgaacggctgtattgcctaggtcagctctattagggctgccaaggttataccgggataatttctttcctagcaagaccatccaaagacataggcttgcttctgttacagaaaggaacagaaacagacttaaagcggcgagttggaaaggcaataacggaaacctcaggttcagtgtgaacaaagtgggagctgagggggccgatgttatgtctttctcactttgccatcgtccgacaccagacgtgagcgagcccaaatcaatatcaaccaagttacacaggtgagagagcccttcttccttatgctcttcatacctgcctgacctttcttttcctttttgcctagctcagaacatcagctgtggcactaaaatgtctcacggcttttccagtattaacggccggggtatagtccctgcattccctggtctgtcagcccgaagcattccggaaaacccagatattcaacgtgagactctgcgtttgctactgcagtattctagggtctcttctctatcagagaattcatcaactccggcaacctctaaccgtacaagagacgaggtccgagattcctggcagactccacagcctgaagtccagcccagtgaagcctcacctcgccaaatatcacctcgactcactcgttcatcaagtggcagccatgtcactcgaccttctcctgcccactctgccgctccttcccctggcagtccaatccgggtttcccgtcgcgcttcttcgcgcgcttcctcccgcgctccttcccgacttccgtctccccaatcagtttctgtctccacttcttcctcacatagcatctctccgagccatcgcgagcgccaacggactcttagggagagcgtggcaatctcgaatgccagtaggaacgatgaggtagttgctcctaagtcaaaacagcacttctcttacccaccggatgtcatgccatctgcatccagatcccctcattcgcggtcgatatcaccgaccgccgagcaaagtttcatccgtcgttctagtcgaaatagagtccagccaaccaactattacgccaatccttgggtgaatgttcccctggaattggaagagccggacacaattgtcaaagctattccggacacagtcgggtcatcttctccacaggagccgcgtcgtgtcccaccacgtcgtgcaaatgtccaaaagctgctgtacagccgtgagcttggaggcggaaatcatcgccccatcgtcactgatgtggtctcggacctaagaccatggaaatcatggcaaggtgcttcgggcgatctgcttgttctggcttggtcgcctgatggcactcagtttgcggcaggcgccgcagctaagtcagacgaacataatatgcagtataacaaggccaacaatcttcttttaggtgatcttcagagcaatcgtctaaaggaaatcccggaccattggattccacgtccaacaacgtcaccggttgatgacccacggcttttcatgagcgtcaataatatgcagtggattggtaaccgactttacaccgccagttttgacaaaaccgtcaagatttgggacgtggaatcaatccgcaacgtatcctgcactcatactttgcagcatgagtcccgagtggcagtgatgtcagtctcgaaattcaatccagatatattggccacagggacagaatcaattttggtctgggacacacgggatccggaaaacttgacatcgactctccttcccctcgaccgcgatgcacggtataagtccaattttgagttctcgtcaacggccctggcctggggtcatactccatcgactctggaattcttagctggaggtctggccgagccaggggaggatccaatatacaaaggtcacctaggcctgtggcgagcccgtgaatctgcatttgaaaccatcaggatggcttctacttcacataatgtctttgacattaagtggcactcttcactgcccatttttgcaacggccagtcctgaagaccctcacaatgcacggattaaaggtatcggcgttaccacgaaatcaattgtgagagtgtttagccttaattgcgacctccaaaaacgcgtgccgtccgtgatggaattctcctgtccggcgttagatgtcaatgaggtcagtttttgtccaatggattcgaacggcacatatgtcaccgctagttgcacggatggcaaaacctatgtttgggatagtcgcaagggtgatgcaattcttcacgaacttcgccataaggccccgcttaacccaattgatcaccaaagaacccgggaaacggcagacgtgggcgtcagggtagctctgtggggttcgtccatggaccagttctacaccggcgcgtccgatggtgttctcaaacggtgggatattcgccgctcacctgaagatgtccttcttgaggatgccgcatcttttgatgaggagatcatgtgcgcatccttcaccgaagatcagtctcatctccttgtcgggggttctggaggaggcgtgcacgtgctatcatcggggccttgttcggaccctaatataaccactttcgagttcgaacacgccccagagcccgaaaagcctagtgatagtggcgtccttgcaggaaaccagcttgtctcctccggccaggttgttaagcacgaaacatttggtatgggtcaagggccctcttacacggggccttttgccttgtgggctagggacgtcaagcgagacgtttcttctgatcgaattagagatgttcctttgctcaagaaataccagagccaacagttggatggaccgccacccagagatcgtgccgaccttgatctgaaccagcgacgagaagtggaaagacagatacaactcgctgaaatacgaaatcgaggattccacaagagaaagcgccaggagcagaatgatccttctacgttcctctaccagggccctatatctttgtcttcccttggctcatcccggccggcgaagaagaggaaaaaaaaggccgaggaaatggaagtgaagagggaagaaaaccaagacgagaatcgagatgagaaagaggaccgcgggggaaaaagagacaacggagaaggccggagagaagacaaagcgaaaaagaaatctcggagcaaaaagaaggctcgcaaggtggcgcgtcagataatcagcaacacagaagatgttgacctgactctcctggactcagacacggagacgtcaaaccgacatcggtttgaccttgaggagctcctagaggctcttgaggatgataattggttcccggccagtggagaaattgaccccaacatccaaaaagagatagtctaatatgacacatttcttgatattgatgtgtttagcatcatagcattgaagcgtggagttctgatttggggtttcctttttacttgaatagtaaattcagttacagagccatcaataatgtttgtgtacatgggagtaatatgaccgataggctaagatcttgaacgtggtagcctgcactccgtacaaatatgtcatgttaatatatgatgttactataaatggcctttatatataccatgacatcaccgcctcgggaggcgcagttcaggtgcctgaggccacaactctccgcttacgtcccgagtacatatcatatccatagaagaagcatgacctctcattctcactctcatcctcactctcatcctcactctcctctgaacctaaactaattgaatattgccacaattcaagttttcagtcttgcaacatattcaatctaatcgtacctgtcacatcatgtcgttcgccccgccctccgggcctcccccgccctcggtacctgagggatggaaagcgcagtatgacgatcgataccagacttggtatgtatttatccatcttaacgaagtccaaaatactgacaatcagccaggtattatgtggaccttgcaacgggcaaatcgcaatgggaccgccctgaagctcccccatcgcgcggtgacgccagtcttccaaccgattctctcccgccatcgtacagcaattcagggcctggcaacccagcagcaatagccggtgtgggagacaagaagcaacccatgggatcgaacaacccctataacccttcaacaaacactagcccaggcaacgccagccctcacacaatcgacgaagacgcacgacttgccgccaagctccaagctgaggaagacgctcgggctggcatacgaggaaccggagccggactggaagatcgtggcgcatcatcagactactacaacgatgcctcgcggccgcaatccaccgggccaggcggatatgcggccggcccagcgtcgcatagcccgatgcctgagaacgaaaagaagcgcagcaagggtggatttttcagcaagctgctgggcaagagttcgagctcaagcagcaggccgtctcggccacagcaacagtacgcctcgtatgcccagcaaggtcctccccctggtgcatactacggtggtggaggctatcctccgcaacataacccccagtttggatatggaccccccggaccgggatacggaggtggtggatattacccacagcaaccgccccgcagacaaggtgggggtatgggaactgccggtgctgctgctctgggtgttggtggtggtttgcttggcggtatgctgattgctgatgctattgatgaccatcatgacagcggtgattacggcggcggtgatgattatggtggtggtgatgacttcggaggaggtgacttcggaggaggtgacttcggaggaggggacttctgagctcggttgcgtttcgatttatttgattgttctgctctttttctccattggtttgttactaggatggacttcgggatatgggacaggcccgtgtacagctcgagggacttataggcgctctggtatcgggagggatctgggggcattgcttttgtttcgcctaaacagctctagccatttatcggcatttggctccagctttatgagccatgagcagcttcagttaattttgtatcatacaatcagccacgaaacaatgacaagataccatgtcaagaacggtcaatataaggaagtgatgatcttctatccgcgcctccgggcaggaccactggtatctcgaccggttgaaccagcctgggccgcattgttggtcgtgggattaggaccaccagtgcccgccatccagctggccagatcaaacccgccaccagccatggcattggaagtggcgccggtgatgggtgaggagcgagaatgttgctcaaattcggcgcgcatctcgggatccactaggcaacagggttaggcacaaagatcggttaggatgaaggggaagagacatactgttctccatgagcttgggcatgacaaacatgagacccagcgcgacaaccgcaagtaacaccatcgggttcttgacaagactcaatggagagactgcgattcaatccatcattaacacaactgaagacatttactgcaggttgcatctgcgggagaagggaagcttacattgcgcgcgctgctcataaaagaccttccgtcccaggaccttggcctccacaaccacatcaatctgcttctttccagcaatatccacgatgtatttatctgccccacggttatcccacgagttcccgcgaaaagtctcccagataccgagaattgatccatcagccgcaacatcgacacggtaaggggcgaagacgtagtcgccagcagagcggatatcgagcaagtaggactcgggctgagcatctggaccggagtatggaagatcatggaacacaaatgttgccgagcgggtcagtgatgcggacaggatgtgatctttcccaccagaggggagactagtgagagtggcatggctggttgcggggaggacatgtgggtttgggaggggactagaggcaggaatggtgattgtcaaagagctggcagataccagactgctaatccctaacaggacaagagaggagagcgagaaatgcatggcggagatgtgttgttgaggaagacatgggggcatgaactgatcagcaagcagttccgcatcacgtgatgtgtctcttctctccagctcttggatgtacgagcatcttgaatcgccaaaaccacccgtctttgttttccaagacacagagcatcatgcctgtctaccttatctccaggtacaaagaaagactttctaaaagttcgtttccgacaagagacacaccgttctaacgtcaatttgaataggatcgcggatcccctcttcgccctggctatgggtgtctctgctgccctcacccgcattcgccgtgaccagcgcgaacagcaccccgaccgcgcatcagaaatcacatacggaagcatcgtacaaacgagcggccatcggttacagcggtggtggaacggagacttccaggatgtttaaacagaaccttgcgctatatcatcgatttggagttttggtttgggaggttctcgccgagaactaatattggttgttgagtcttgtattccgtgttctatttgtacatatctacaaaagttggtaatagcatggaatgatggaatggtcactctataggcaccgggaggatgcaattttcgtatagtttcagtcctaagtgtggatggcccgaaggtccgaacgagggctgtttggattctcttatgatctacgatgtacagaaagaggggtttttttttttttttttttttttgaattagaaagaattttgattcactaggctttttttttccctagaaaaagagataaccttgtatctatgcaatcatgcgcaaaaggaaaccttgataccccataagttcgtaaaacaagacgtgaaaggaaacgagtgccaaatggcaaataatcaagaatcattcagagcgaaacatttagtcaagctcctcgggcttctcctcgacctcgtcagcggagcgggcaccctcgggggcaccagcgccagggggagcctggccgccgtaggcagcggagatgatggggttggcaacagcctcaagctccttctgctgagactcgtactcgtccttctcagcagtctggttgctgtcgagccagccgatgacctcgctgatcttgtcctcgaccttcttcttgtcatcgtcggagatctggagcttgccctcagaaagagtgttcttgagggagtaggcgtaggactcaagaccgttcttggcctgaatacgggcagcctcagcctcatcctcctccttgtacttctcagcctcggaaagcatgcgctcgatctcctccttggagagacggcccttgtcgttggtgatggtaatcttgttagactttccggtacccttctcgagagcggagacgttcatgataccgttggcatcaacatcaaaggtgacctcaacctggggaacaccacggggagcggggggaatgccagtaagctcgaactttccgaggaggttgttgtccttggtgcgagcacgctcaccctcgaagacctggatcaggacaccgggctggttgtcggagtaggtggagaaggtctcggacttcttggtggggatagtggtgttgcgcttaatcaaaggagtcatgacaccaccagcggtctcaataccgagggaaagaggagcgacatcgagaagcaggatctcgttggtggacttggaagactggtcaccggacaggatagcggcctggacggcggcaccgtaggcaacggcctcatcggggttgatggacttgttggcgtccttgttgaagaagtcggagacgagcttctggatcttggggatacgggtggaaccaccgacaaggacgatctcgtggacggaggacttgtcaatcttggcgtcacggaggacacgctcaacgggctccatggtgccgcggaagagatcctggcagagctcttcgaaacgggcacgggtgatggaggtgtagaagtcaacaccctcgaagagagagtcgatctcgatagaggtctgggcagcggaagagagggtgcgcttggcacgctcgcaagcggtgcggagacgacggagagcacgggcgttggtggtcagatccttcttgtgcttgcgcttgaactcgttgacgaagtggttgaccagacggttgtcgaagtcctcaccacccaagtgggtgtcaccagcagtggccttaacctcgaagataccctcctcgatggtcagaagagaaacatcgaaagtaccaccaccgagatcgaagatcagaacgttgcgctcaccctcgaccttcttgtcaagaccgtatgcaatggcagcggcggtgggctcgttaatgatacggaggacgttgagaccggcaatgagaccggcgtccttggtagcctgacgctgagagtcgttgaagtaggcagggacagtaatgacagcattgttgacggtgccaccgaggtaagcctcagcggtctcacgcatcttgacgaggatcatagcagagatctcctcaggggtgaactgcttggcctcacccttgaactcaacctcgatgacgggcttggtagccttctcgatgatcttgaaaggccagtgcttcatatcggcctgaacctcagcgtcgttaaaacggcgaccaatgagacgcttggcatcgaagacagtgttgtgggggttcatggcgacttggttcttggcggcatcaccgatgagacgctcggtgtcggtgaaaccgacgaacgagggggtggtgcggttaccctggtcgttggcaatgatttcaatgcggtcgtcacggaagacacccacacaggagtaggtggttcccagatcaataccgacggcgggagccatggtgaatgtgtgtaatcgttaaaaaaaagaaaagaaaaggtagaaagagattcgtgaggcaagaggtaggtagtgtacaaagagtcaaagggtattttgatgagagaaggaaagaagaagaggaaaaggacgagggctgagaaaagctcctatatagtgagcggtgtattactccagaagcttctagagggaggcttccatagggatccatgagattccatgagcttcgatggcccagcaaccacatcattacgtccttcatcaagactttagtaggttccagatgagcctagtggagtcgtcaagtctacaaattacttgattgtctataaactccttatcgacgatgtcaattcctcctttttttcactccgattcatgttcttcttcgacgttctcagctttttttatggcggggctgtatgatgtaatagtgggatgacccttaaggcggtgtcaaatatgatattaatacaggatgaatactggtcaccatgggagaccgtatgattatatgttttgggttgtcttggggtgaaggtattattggtaatggtatggtcagttatgtatgcgtcatagtgagttcatgaccatttgaaatctgctgactaacttcggatgggtgtttttccggaaatacatagtatattatataatcatagctgcctaaggttcccatggaaccttccacggcttttctttccacatccatcatatccatcacctatctatctaggtatctacctaggcatgcaggtaacatttatagatggctaaattctcacactttcttaaaaggtcaattcagactatctttcagtctcaccgaggtattaacttgaatgatctagctacatgcttatacaacataaagaacttaataaagaacttaagaacctgtgtctcatctagccatatcatgtagaatagtaaacatgggaaccctctaattccccttccaagagcctgatgtgtatcctacctacggagtgcggagtacacagtacagagagagagttatggagtaggaacatctgtgatctatcccgttctaaacaaatcggagttactccggagaaactacagttgcctcatatttcttattcttcctaagccttagaaaggctgggccaagaagccttgcgccatccgcgctaagcatttctccttacccttgtagatgtaacatgcacaggtggcatttcctatccaatcgggaattccttctttatctctttaggattgcgaatatttaccccagtcgcacatcatgagacatttttaaagtagatttagttttgagataatatatttcatgggctatcgtatctcattaggattcctctggattcttctgaatcctcttcgacatgttcactgcattgaagagtaagaggcccgaggaccaattcgaggtcaaaatagatcaagggactatgggctcagagggtctagagttcccttctaaaagcccaaatgtggcggacaccgcagtggacgaagaaagcctccatttcaagggggaaacagccgccattgaacaagagacacacgataaccccgagattgctgcattgcccttgtccgtgagacaactgatcaacctgaccgatgaccccaacttaccgacgatcacctttcgttactttgtgctctcgatcatctttgttatccctggagcctttttgtcgcaaatgagttacttccgcacaacgaaggcaccatactccatcttctttgttcaaatagcctgtcactatgccggtcactttatggccagagtctttccggactggaagattggactacctggcactcgcttttcttttagcctgaacccggccccatggagcatcaaggagcatgtcttggtcacactgactgcagcttctggagctacgtacaatctgggatatgctcctatcgtcctagcagagctttggtacggtacacgagtcaatccggcggttgcaatcttcttcatgctttcgatcgtatggattggctactcctttgctgctcttgcccgtcagatccttttgcctgacccggagtacatctggccccaggctttgatgcagacaacattgttcgagactttccgcaaaacagacacctcgtcggctctcgctcggcgccagatgaaggtgttcttctttgcgcttctagggatgaccatgtggcaattccttccagagtatgttttcccgttcgcctcatctttggccttcctatgttgggtagcacctcgcaatccggtggccaacttcattggctcaggcattggtggaatgggcttcctcaatctctcgttggactggtcaaacgtgaattggaatggatcctctatcatgacgaccccatactggactcaggtcatcttgttcttggcctttgctttcaattgttgggtcctacttcctgcagcaaagtgggggaatctaggttctttcaagcatggactcatgtcaaatagccttttcctgggaaatggtacaacctacccgaccctcgatgtactcaccccggactatcatctgaacatgaccgcttatgaggagtatgggccgatgtatatggggttgcaaaatgtatgggcgacatttttcgactacgccaaacttccagcagcggtcacttggatcttgacatttggatacgcacaggtttccgggaatgcccgaaggatctggtcgtctcgcaaggcagagaaatccacgaagagtgaaagcattcatcaccagtatcacgaccgtctcaacgttatccagagacagtacaaagagattccatggtggtggtatgctattctattctccgtagcctttatcattctgattgtattccttgcactcggacatctcttcatcccgatctggacgttgtttgtggcacttgcgagtgctgccatcctggtcatcccttttgcttggctttacgccatttccaactaccagcttgagacgggctctttcaacgaactcatgtacggctacatggtccatacaaaagccggagaggcccaccaacacccctgtggcccttctgtctatgggtctattgcgggtgacgcctggtatcgtgcgcagtatatgctccaggaccaaaagatcggtcactacatgcacattccgccccgcacggttttcttctctcaagttttcggcacttgtatgggtgttccaatcaactatgctgtcattcgttggatcatggacaccaaaggagattatttgactggtaaaaaaatggacccattaaatcaatggacagggcagtccttgcggacttcaaacacaatgggagttcagtacgctgtgcttggtccaaagaggctttttgctgagacagaaatggccgtgcttccctggtcattccttataggggcagccattcctcccattctcttctgtttccaccgattcttccctcagcttcgaattgacctgtggaatgtcagtatcttctttgggggactggcgatgttctatggtaacatcagtactggttacacatctgccattattggtgggtatgttgtaatgtattgggcttatcgtcgccatttcgaggtttggaagcggtacaattacttacttgctgctgcgtttgatgctggatttaatctcaacatgttgctggtcttcttctttttcggagcaggcaagcaaatttcgatgccaaaatggtggggcaatgatgcaacgtctgtggaaagatgttttgctcttgaaagctgatttactttcatgattcagtaaaggaatagctgatattatgcgttataatatgaaatttatgaaagttgcctcttcacacttcacaaatgcagacaaaggtagcgtactagtatgttgtaatattgctgatgcctggggttatcacttgcctatagaaccaagttagatagcttttatatatttgcttactttacttctttcaattcattttcagttcgtttccggttggcacttgtacttggtgcctcagggcaagatctgtcacggggtttgatcacccgcgatagccaatcagacggtgagatcgcccttgcaggttgttttggttcgagggggaggaccttactttgcagaccgtcttttaaatttcccttgccccctttccaccaaccatccttcctacaattctccatccactctaactaaacctcatcatggctgaccagacgactatttccaaccccaacgaggaagccttcgccaagggcaagggcaaggctgaccccacgcaagatatgagcatggatgaggagagcgagtctgagagcgagaacgagatcgtgagtctacagtttccacgcccaaccaattccttttatgctgacttcctcgcgcgttactaggctgacaatggtgtgtacccccctccccccccccccaacgatcacccaagcaaccatgtctgaatggccacatgcttcagaatgaccgtcgattgacttcatactgaccctttctgttcctagatgaggatgaagacacacaagacaacctcaacgaccccatcgaccagagcaacatcatccagggtggccgacgcacacgcggcaaggtcattgactactccaagatctccaccgatgagatggaggatgacgaggaggatgacgaggaataccagagccgtgaggacaacgagaccaacgatgatgatcagatgcgcgactaagctcgatgaatacaaaacttccgggtggcatggaattgctttgaacgataggcgccacggatcggtctccacgatgtttttctttcgcgtgtgtccataacatgtctcacgattgtgtgatggcaatgaatcaatgaatatctcttcggttctctgttcctaaacccgttaatatacacctagtccattatggattggccgatgcctatgggttcagcctatgatgatgtaatttgtagagctaatggatatccacagcttggaatgggcaacgcatcattgcccattgtattccaccataatcaatcctacctgacctaatcgagaataaacagaatcccacatgaaccacaactgctgtgtatcccgcatgtcgattctagaacttggtctatcacgtgctgttctgctgttcggcgaataacaacgctatggccaccttgatgtttttagctccgcaagcatcgaggacttgaacagtgatcgccttggattttgaccttttaccaaatgccccattgctgctgaacaacttatccacctgcagtttatgttcctcctctccctcccgtcgcgaactctagctacattccacgaccgccatggcttcacggtatagttccaccatcaatatctcggttcattataaggtcgccttcagctagctaatgcagcagtaatcgaaatagatttccgcgtcaacgtgatccccgcgcctcttcgtctctcttcgatcaatacggtggcgactctcgccaagctagcagatcgcctgcccaacaacctggtggatacgggtatgggggctactccagtccagcacctaatggttacgcgagtagcggtgcagctggagcgggatatcaaagtgcatcgcctgacaaaaagtgcgttgagtggctcatgatcttttgaggtcttccgtcgttcttccgaggaaggatgtgtagttgctaaccaagtctttgttatagggggcactactccgatgcagttctctcatctctcgagtcacagaatgacgctgaagttgagggtatcagtgccaaggtcaaaatgttgaagaatgtaagaagcctgcaccccaaatctccagacccagcaaaagcaggtggtcgtttaatggcaaccgctgacaggaaaaccatctagatcacactcgcaattggcgatgaaatccgagacacctcccacatcaccgacctcaacgattcattcgacaacacccgagtccgactccgcgggaatatgaaccgcatgcttcgcatggccgacagcaccggcatcggctggcgagtttggctcggcttctttttcgccgtcttcctcctgttcttctatgtatgggtattttgaacgtatacccttgctgtctctcgaagacgtgcacttgcgttctatactatgtcgtccacgcccgcctttttcgtctttatcatctttaatctctcgtcttacttcacgcaaaacccagcgactttctcttttgctttttctcgtatggatcgaaccacgcgcatgacttatcagtatcttcagcatggggatcttggctttggtgctatgaggtgttctgggagtatggattctttgagccatgtatatgaaaacctcttccattggctcagatgtcggccacgtaccgctttctgggttggcacgttggagatcttcctggcatccatctccggagataatccaggaaggatgtccgatgtgatccggtgatggttaggttatttctgggttggtattggaagatgttttaagaaaactgtacatagtgcatttaaacaacatacagggactatcctgacaaaagaaaccatttataggtcaagctttgattcccctggctgtgtttacctcaaaacgtgtttgaagtcatgttcattgaatcttcttataaggaggtatcgtaagctgctatcaaaactccgaggcagaccccctaggtctatctttttaacctgacacgaaaacgccgtagatgataccgaacaagtctaacatcattttggatagcttcgctagttcagactatccctaggccctccgatgtggcgcgggaaccttctggcaaacccgcttcgtcgactgccctgactcgttatggacgcgcgcaggtcttcgtcgctgtaaagcatgctgctggaatccaacgcatcgccaccaccgctccagcgattgaggaaacggcgttgggcttcagtctcgggctcgcggcgcaaagttggaggtggaggcaagccacgactgtttggcgtgctggtgcggaagttctccgcaaacctggtttggataatactgggttcgttttcatcgtcctcatcactcagctcctcttcgctgtccgtgtgctgccattccccttcttgctccgaaccttgctctgcagcatctgggatatcatggtcgaggtcgcgcgtcatgtcttcactcacactgtcaccgtcggcggcaggtatctccgcatccagatcaggctggttgtcgaaatcgtcctcttcttcgtcatacaggcctgagcccccatagtcatcatcggggaaaccttcagggatgtcatcatccaagtcgcgctccatatatgacccttcatctccaatgtcatcttcctcaagcccttcttcgccttcctcgataagacccgaggcctcctcctccgcgttggggatatcgtcatccaaatcacgttccatgccttcatcctcttctacttcctctctctgcatccctatgtcatcatccataattccttctccctctgcagcctccatctcagccgcggcagcctgtagcgcctcttcgcgctccgcttcctcctctttcataccgagcattgtcttcgcacaccccgccggtttgatccatgagtatccaaacgacgcgatgttcaattttcgagcgcgtagtgagcgttcttctgcggccaatgtggcaattgtgttggcagaagagcgggatggcatgaatgagcgattactgctggacgacgtgccggcattgcgtcgggcgaggtggtttgcagcggaattgtcgccagcttgttgatcggaggtagagcgatatggttgagaggatccgaaccagagttcgtgggactatcaagttgttaatttcctcgagggctggtttgagatgcgccagcacctacgtcgcgcggggtgatggatgaaagggtgagcatcactgcaatgattgtttcaatatcacatttgggaataccctgcctatattgtatgccagggtttctgtttatggagctttgtggggatgtccctgcgatttggagatacggcgggttgtagcggtacaaagtagcagtttgtttatggtgtggggcgaggagtggctaccgggtactaggacttcacccgtgtgagctttgatgaaaggaagaagatatagagaagcaattggagatgtcaagggcgttataacccaaccttggaaagatccaacggggaaagcgcgcagaaaaggctggagctccacagccaatcaattttcatctatgcggggggaatcctaactacttccatacctacctatgttgtaggtacctacctaggtagctaagcatcatgtataaaaaaggctctttcaagtagtttggaggttaattatattccgcatagtatcttctattaacattggaaatgtctatagctttaaacagcattctatattatatgggtcgaagggatcaggttgaatttcatctttgaacaatgaagtgtctagttttagcttcaaggcaaattagcaatgctctcaccgttgtactccgtacttcgagagcagatcccagtgaatgatggtgccaggctttcattaatccaggcccttacatagctacagacactgcatatgtacgccgtcctacaatgcataagtctaggaccagtggagatgtgagtttaggtctcagctaaatgattactgcctgagacctacttcgtacaagacaagacctgaatacaggaagtgagatgctgcttcatcgttattcccactgcgatgccctagagaaatttcaatgtagttctaagatattaccgtgaatctaaaattgagtattagttaaagtagaatcttgagtttcaaaataaggaggtatggagcatacggagtacagagtaagtagttaatggagcgctcaacattccagccaatgtctacaacataaagttgtggatatttccgaaactacccgataccagcaactcggtgaacttaaggacaggaggacaggaggaaaaagccgggtgtttcgaaatttgaaaaagaaaatgaatggcgtctgactttcatgtgcactttcactggacgcagaaaaggtggggatcatgtgatatccactctggggttatgaacacgggtacggagtacattggacatactactatgtggtatgtagtatgttgtatgttgtaggtaacagatgtatacaatgcagcttagaagatggtgtatatgagccattgaaaaaaagaggaacatgatgcggagaatactggtcctgtttcacccgatcgtgatatcaatgtatattgtaatgggctgacacacccgtggactcgtatacgatgtagacagccaggcgaaaagaggagaagagatccttagagagatcagagttatgtattctaattatcatcttctaactagttaccttatctctagatcttcgcatgtctggacggatcactttcctccggactcttaactctttcaatttatccctacaaagcatatttctggaatgtaaaatatggggaaacatgatcaattagcagatgaattcccatattctcgggggcactatgaatgcctagtcaacaggccattatggaacaataaggcagttggggtgaccttaaaagaatgagctgaaatggtcatccgcaaacggctcagggcccgaaatcgggctagctacgttcattggcatctccaaagtaaggtgagagggaaaacccgggatggacttggccgttgtcggaatgtgtcgttaccgttacaggtatttatgcattttaatggatcaattgatgtctttaccccttggaacaatttcctacttgttattttctttccgtattcctcttttttgtgtataaacttgaatcctttttatttagattggtacttttcgagtaagttttttagtacttttgctttcggttctcctacagaaaacgcaaaccagcggctcgaaatcaaatggattaagcacatctttgccccactagggagcgcgcccattcacccgggttaacatgtgaggattgtccttattcttggggagtacggaggacggagtacattggatgcactttgaatatgtccaatgagcagctctgatccttttatgggcctatggggcctatgggacccactagaccttgtctttgagcttttagagagaagaggaaatgataagtataatgaatatgaatatataaagtagtatggagtagtggtagttttcaatatatgaatatattgatatactaatatacgaggttatattgatatatactaatatccctaggtagtatatagttatagttagtatagttatgtataactagagtccccacgaaagttagttgacgtagtaaagagctaagggtcgtaaaatcttcactctgattggtcgagcgatgcttatcttgggatgatttgcactccgtaatcataatgattatcgattatcattactttggctctttgggctgtttccgtcgattttgtcttttcatatggttaaaacgtgcgttcagaactaaatggtatgctgtatgagcatgtgtatgtaatgtatagtgtatagtgtataatgtataatgtatcgtgtagcacatatttcactcttatttctttcacttgacctccccttaccgttctcttggctgctttctaacaatttgccacggtagactcccccaccattgtaattttcccttttgggctacatcgggagcttgcaatccccggacctgctgtcccgccgtaatcgcccatccttttttctcccctctccctctccctctcccctccttttttctctgtttctctgtttctcctttcaccttttccctcttcgatcttcaactctttcgcagaagctgggtgatcattgacacatttcttcctccttcgcgccacgacttcctgtgacgacatcaccagctgtcaatccccaaatcgggtgggtcttcttagcaacaatccccttcagttaccattccattctctgtcggctcccggcggaagaatgggtcttaacttggaggagctctatggcaaagatataagtgaagaacaggctcctcatgagtattctcagtaccaacccgaaaagggttatggctgggccaatgctctgccagagcggcaaggtctgtacgatcctgaatatgagaaggatgcctgtggtgtaggcttcgcagcgtgagtgaaattttctaagactgtgccccctctccccctcctttctcccccaattggaggcatgaagacgaactcaattctgacgagacaacccagtcacatcaagggaaagccaagccacaagattgttagcgatggtgagtgccagttttctgccctttgaggaacgacaccagaacaagtgaagctgatggcaattgaacagcccgcaatctgctgtgcaacatgacccaccgaggagccgttggctctgatgcacgggatggtgacggtgctggtgtgatgaccagtattccacacaaattctttattaaaaacttcgcccgtgaggtgggtgtggatctccctccattgggacaatatgctgttggcaacttgttcttcaagcccgacgaggaagctctcaagcagtccatagtggattttgaggaactggccacgacgcttggcttgcgtgttcttggatggcgtgaagtgccacgggactcaactattctcggtcctgcagcactatctcgagagcccattgttatgcagccatttgtggtcttgaaatcggcatacggtgaaggcaacaagccagagatcactgacactgaaaagttcgacgagagaacctttgagcttcagctgtacgttctacgaaagcgtgctactcatgtcatcggcctcggaaactggttctacctctgctctctcagcaaccggaacatcgtctacaagggtcaactctctcccgtccaagtgtacacgtactaccacgatttggtgaacgtagactacgagggccactttgccctagtgcactcccggttctctacaaatacgttcccatcctgggatcgtgcccaacctctgcgatgggctgcccataacggtgaaatcaacaccctgcgaggaaataaaaactggatgcgcgcacgagaaggtgtcctgcggtcagaggtctttggtgacgagcttgacaagctttaccccattgttgaggatggcggttccgactcagctgcgttcgataacgtgcttgaactactcatgataaacggcgttctgtctctgccggaggcagtgatgattatgattcccgaggcctggcaagacaaccccgccatggatccagccaagtccgctttctacgagtgggctgcctgtcagatggaaccttgggatggcccagctcttttcactttctccgatggacgttattgcggtgccaatcttgaccgtaacggtctccgtccctgccgtttctacgtaatggacgatgaccgcatcgtctgtgcttccgaggtcggcgctattgatattgatcccgagagggtcgttcagaagggccgcttgcagcctggaaagatgctgctggttgataccgtggctgggcggatcattgatgacgctgagctcaagcagactgttgcccgccgccaggactttgccggctggctggacaaggggcttctacagctccctgctatcaataagttgctacttgactcgaacgtcgatctttctttcgccttggacaacaacactattcagaacgacccccgcctccgagtgttcgggtactcgtttgaacaagtcagcttgattcttggccctatggctgcagactccaaggaagctttgggctctatgggtaatgatgcacctctcgcctgtattgcccttcagcctcgcctactctacgaatacttccgtcagctctttgctcaggtcaccaaccctcccattgaccctatcagggaggctgtggttatgtctctcgaatgttacgtcggtcctcagggaaacctgctggaaatggacccttcgcaatgtcaccgcctgcgtcttccctctcccatcctgagcattcccgagttcaatgctttgaagaatatcaacatagcccacaacgattggaccgtgcgaactatcgatatcacatttgaaaagagcaagggcacggctggttatattgaagcgctcgattccatctgcgatggtgccactgaagctatccagaatggcgataaggtcatcattctctccgaccgtgctacatccgccgaccgtgttccagtctctgccttgttggctaccggtctggtgcatcaccatctcgtccgaaacaagtggaggtcacttgcggccctggcagttgaaaccgctgaggctcgcgaggtccaccaccactgtgtcctgctgggatatggtgccgatgccatcaacccttatctggctctggaatgtattctcaagatgaatcgggaaaacttgatccgcaaggacatccccgatgagaaggttgttcagaactacaagtcatcctgtgatggtggtatcctcaaggtcatgagtaagatgggtatctctactctccagtcctacaagggtgcccagattttcgaagcccttggcattgacgacagcgttatcgatcgttgcttctccggtactgccagtcgcatccgtggtatcacctttgatctgattgcccaggatgccttcgccttccatgagcgcggttatccttcccgtccgatcgtcgaagtccccggtctacccgaatccggcgagtaccactggcgtgatggaggagaggcccatatcaacgatcccaccagtattgcaaacgtgcaggatgccgttcgcaccaagaacgacaagtcctacgaggcgtacgccaagtccgcacatgagcagatcaagaactgtactttgcgtggaatgttggacttcgattttgatcagcgtacgcctattcccattgaccaggttgagccttggaccgaaattgtccgccgcttcgtgacaggtgccatgtcctacggatccatctctatggaatcccactctacacttgccattgccatgaatcgcctgggcggcaagtcgaacactggcgagggtggtgaagatgccgagcgtagcaagaggatggagaacggcgacacgatgcggtccgccatcaagcagattgcttctggtcgtttcggtgtgacatcgaactacctcgccgacgctgacgaactgcagatcaagatggcccagggtgccaagcccggtgagggtggtgaattacccggccacaaggttgtcggccccattgctcgcactcgattctccaccccaggagtcggtcttatctccccgcctccgcaccacgacatctactccattgaagatctaaagcagcttatctacgatctcaagtgctctaacccccgatctcgtgtttccgtcaagctggtatccgaggttggtgttggtattgtcgcttctggtgtggccaaggccaaggctgatcacatcttgatctctggtcatgatggtggcaccggtgcctcacgctggaccggtatcaagtatgccggtcttccttgggaactgggtcttgcagagactcatcaaactctggttttgaacgatcttcgtggtcgtgttgtggtccagactgatggccaaattcgtaccggccgtgaccttgccatcgcctgcctgctcggagcggaagaatatgggtttgccacaacccctctgattgcattgggatgcattatgatgagagtgagtaccttcagtctctgatttcctgatgagaccagcctattgacaaatatattttccctagaaatgtcacctgaatacctgccctgttggtatcgcgactcaggatcccgaactgaggcagaaattcaagggtacaccggagcatgttattaacttcttctactatgttgccaacgagatgcgtgctatcatggccaggctgggcattcgttcggtcaacgagatggtcggtcgtgctgagctgcttaaggtccgggacgatattcgtaatgttaagcaggaacggattgacctatcactcatcctgaccccggctcactcacttcgccctggagtagctacctacaatgttcgcaagcaagatcaccgccttcacacccgcttggacaacaagttgattgctgaatcggagctcgctcttgagaagggtctaccctgccgaattgaatgcgatatcgttaatactgaccgtgctctgggtgctactctctcctatcagatcagcagacgttatggcgaagctggtcttcctcaggataccatccacgcgaacattaagggctctgctggtcagtcctttggtgccttccttgcccccggtgtcacccttgagctggaaggtgatgccaacgactatgttggcaagggtctctctggtggccgcctcatcgtctacccctcgcgcggagccgctttcaaggccgaagaaaacgtcatcgtcggtaacacttgtctttacggtgccacccgcggaacttgctacttccgtggcatggctgctgagcgttttgctgtccgtaactctggtgccactgtcgtcgttgagggtgttggtgaccacggatgtgagtacatgactggtggtcgtgtactaaacctcggacccactggccgcaacttcgctgctggtatgtctggtggtattgcctacgtcctggataagaaccaggacttccattctaaagtcaacttggagatggttgaaatctctagtatcgaggacccgtcggagattgcctttgttcgcggtttggttgaagaccaccatcactacactggctctgagttggctgctcgcatcctgctcgactttactcgtgctctcccccacttcgtcaaggttctgccgaccgactacaagcgcgtcatggaggaagaggctgccaaggcggaggctgccaagaaagctgaattcactcttcctcagcttcccagcatccctgttaaagccgagagggccgaggccgatcattccaagaagactgacttgctggacattgaagacagcattagcgattcgaaggctgagaaaaagcgatccgcattgatcttggacaaaacaagaggtttcatgaagtacagccgccgcagtgagaagtatcgcaacgcaacaacccgtactcgtgactggggcgaaatctcccaccgcctcagcgaggacgagctcaagtaccagtctgcccgttgtatggactgtggtgttccattctgccagtcggacactggctgccctatttccaacatcattcccaagtggaacgagttggtattttccaactcatggcaggatgctttgaaccgtctgctcatgaccaacaacttccccgagttcaccgggcgtgtctgccctgcaccctgcgaaggatcctgtgttctaggcattaacgaagaccccgttggtatcaaatccatcgagtgcgcgatcattgaccgtggattcgagatgggctggatggttccctgcccccctaagacccgctctggcaagatcgttgctatcatcggctctgggcctgcgggcttggctgctgctgatcagcttaaccgcgctggtcacagcgtcaccgtttatgagcgtgccgaccgaatgggtggtcttctcatgtatggtatccccaacatgaagcttgacaagaaggttgtccagcgccgtatcgacctcatggccgctgaaggtatcaagttcgttgcgggcactgctgtgggccctgactgtgaggtttctctgcagtctcttcgtgccaccaatgatgctgttattgttgccactggtgccactgttgcgcgtgatctcaaggtcactggtcgtgaattggatggcgtgcactttgcaatgcagttcttgcataagaacaccaagtcccttctcgactctggtctttcggatggcgaatacatctctgccaaggacaagcacgtggtcgtcattggtggtggcgataccggcaatgattgtattggtacctctgtccgccatggtgccaaatcggtgaccaacttcgagttgttgccccagcctcccccagagcgtgcccgtgacaatccctggcctcagtggccccgtatctaccgtgtcgattatggtcacactgaggtcaagacgcatatgggcaaggacccacgcgagtactgtgtcatgtcgaccgagttcgtcgacgatggaaacaaccgcgtcaagggtatcaacactgtccgggttgagtggaccaagagcgctaccggcggctgggacatgaagaccctcgagggcagcgagcaattcttccccgctgaccttgtgctcctctctatgggattcttgggtcccgaggatcgtgtatttggcgatgagattgagcttgatcctcgcaagaacatcaagacccctcccggccactactcgaccaacattcccggcgtctatgccgcaggtgactgccgccgtggacagtctttgattgtctggtgagttttcgtccaatccttataattagcaactcactaatataatttcaggggtattaatgaaggtcgccagtgtgctcgcgaagtggacactttcctcagcggaaccagctcccagctcccagtcacgggtggtatcgtccgtcgccctgccatcgactccgttccccaacccactgaggttgctgcttaatctagcggcgatgcaggacatgttttacgacgctgacggccattatcatgataaaattttcatttcgacgcgggaaagttaatcaaatgggataaacttgtggcatatacaggattccatggggttggttctccgcgcgaatgaaaaagcctacaatactgcgctttcttgagttttgctttctactttctactttccatttttatttctttgattttcatcttatgttttgcttcagcgtcatttttctttgccttttcagggtctgcaaggtgtttagagcgtctgccattcggtgatctctctatttctgctgtacatagcttttctgcaaatctgactatgttccatcattgtttcaaattcgtctataaagtggaatgcctcgttttctttgagtatcttttatgtctttgtgtgaaagaacgaaggacaaagacctaaagagtcaacaatgtctttatgcttctttctttggcaacttcccgttgttagactgtgcatggccggctttgatggctaacctatataaccgcccaaatatcccttgctttttcggaccgttccattccattcattcatttcaactaatccagcttacctatttcacagatttacaggtcctatccatctcaaacatgggcaacgaagccaataagacagccacggctgcgaacgatctcaatcccaacggcttcatcactgagcgcgaggtcgacggcgagcggcgttctgtccgccggtataatgatggtcgagtatctgggcgcggtgggagtatcgagggtacccgccagggctcccgaaagaactccacagggatcagcggtcgcgccaggcctcccacctctcaccctagggatctggactgtcgatctactcctgctgcgtccggtccatccgatgtcgctgatatcactgctgccatggccaagctcactgttgaccatcccactagccctaaggtaaagaaactcagcaagaagttgaacctcgatgccgatccggggattgagactgtgaccctgcaaaaggtcactgcttcacctacgcctagtgtggcttcctctacgtgcagcgcgggcagcaagagttctgtcaatgctaggatagcggaaattgaagatcgagtaaggaagcacatcaagtcacgactccagactatcaaggaggaagatgaagagtaataaagaatgaagttcggaatgggctagagaatcggagaacatcatttacctgccttccattgaattgctggatgctaacttcttaaatcattcctaacaataggtcttacaggcttgcttcgcagttgagcttttatatatgcacggctacttacagcttcccagtctatgcccaatgccatgaatggatatgaggtaggcacgttttgagtttcctctttgatatcccgaaacatgtctcttgtgtctatgggcttaaagatctttgctaactcttctggttattaggtcattcatttatgcgttcttcaagcatctcttgtggagttctgagtcaatcaatctatttcagcatcattctctccctccagtagaatttcatagatcgtgggacatagttgtaaaacccgtgtgaagtcagatttgagaaatactgagcatataagaccataatgtgtaaaaagaaatagcctctaaagtgctatatgcgaattcgcggggtcctccatacgaccatttaacaaacgccgatacacaggggaaatggagagtatcgtattatacaagagtaaatgaaacaagagggtgtatatctacatatcgtaacaagaaaaggagaaacaagggacatcatgaaaccgccttttccgcctgttgtttcgctgcttcatcttcagccttcatctcctcccacattgcggcaaaatctcccttgaacgagtctttggctggatctagccgcacgtcccagacatcctcactgctggggcctgtcttgtacttaatcgccttctttcggttgtggtctcggatctctctcctgcgcaaatcttctggccaagttcgtgtcttcatgcacagccatagattatcccagtgatcgctgcatgaccgtagttccccatatcgataaacattcacaaattggcctccaaaagactggcaaaagaaggcgtaatcgaaggcattgcggcaggacatggtatcttggtagagggactcgggagagatgggtgatgaaggtgtttgggattccggagacaggttgccatcaggggtcagccctgttcgtttcgagagcgacgcatcctcagatctgagatctgccaggatttgattgaattccaagtcggcttgttcgtcgggggtcaaggtctttgatggtgcattctgctttgctggttccgtaggaattgtggatggagtatccttgggcatctccttaggagcttccttgggacctgatccccacagccagcccattttgtttttgcgagaggaaagaattggtggatctaccgcaacaccttgaaatcacgaggttatctttttttggtaatcaagatgtcatgtgactcatatacccaagtcacgaaccgacgtcattaatttggcaagtcgatttacacaacttgacttgtttcgctcttccaggctggtttctttactttctttttatattctttttccattggatatgtgtacgtgagcagaatgagatcgatacccgtatcaaaaggtccgttggccctttggtctccagcaggttctcatatcagcgccaatgggtcccgggggtggagacctccgctttggggacgctcgatacgatgcacatcttctatcagatcgggacatatttcagtaggagaaaatgaagggattatctatgtcaatagtgagcgccaattgattataagctatcatgcctactaactagctctagatatatttccgcaccggttacaatggctactgcggggtcctctcagccatattcagcctctcgaggggtttttggcacgagtaaacaacccagaactagcggcagctgaccccactcgtattgttcaacaagcttttccaagagacctaggtctggagatcaaggaggtcgtgacgagatacaaagagggaggtgcattcgtgaagtatgggcttaagtcggacatcagcaacgaaactatccaaaatgcaatcaaggagcatttgaaaaccaaccccattaagccctggtttaacccgaccctgaaagtcgatgcggaccttgttcgcggaacgccgtggatcgaagacctctatcgaatcccaagccaaaccctaaaggtggaattcttgccaacgtccccagataactcagcggcggaattaactcaagagtccctatactcactgttccggccttacggcaagcttctggacatccaaacacagccctcagattcgaaggtcgaaccacgctatgcaattctgcgatttgagcgccctcggttcgccgtgatggcaagaaactgcatgcatggatttattgtttcggaagaagcagggggtggcaactccggtacaaggttcaagatcaactacgagcgcaagatcaaactgtttatgatcaaggactggattttgaaccatccgagactagtgattcccgctatagctgctctgatagccactatcacggtaatcatcttcgatccaattcgcacgttcttcgtcacgctcaaaatcaagtcatcgttccaaagtgaagagaaccccgtgctgcggtgggttcgcaaacaagccagcaaagcgagcatgttcccattcgggaagcgaaagtcggacccgcgaggtctagcagctatctgggaagaccgacaaacagagattgcgcaactgcgagcctggttaacggagactgcggagaccttcattgttatccacggtccccggggctcagggaaacgcgagttggttctagagcaagctctgaaagagcacaagtataaagtcatcattgattgtaagcaaattcaagatgctcggggtgatacagccaagatttcacgagccgccgctcaggtcggctaccgaccgatcttctcttggatgaacagcatcagcagcttcattgaccttgctgcacagggaatgattggcactaaagctggcttctccgagacgctagatgcacagttaagcaagatttggcagaatactggtgtcgccatgaagcgagtcgccttggaaggtagacgaaaggaggacaaagatttcaacctgtccgaagacgaatacctggaggctcatcccgagacgagacctgtcgtagtaattgaaaattatctctatgatgcggacgacagtgtcgtgctcgacaaacttactgaatgggcggctggtttgacatcggcaaacatcgcccatgtcatctttttgacgactgatgcctctttcgcaaagccattgagcaaagccatgcctaatcaagtgttccgcacaatttccttgggtgactgctcgctcgaagttggtcgtcgtttcgtattgagtcatctagatgcagaggcaggcgatgacgatgaacagaatgcaaggcgcaaagagacgcttcgtggtttggattattgtatcaaggtgctgggtggtcgagttactgacttggagttcatggctcatcggattgaggctggagagacccctgaaggtaatcctaaccttttgttgcaccttgagaattcggttaaccgttgtatagctgccgtggaccgtatcattgaacaatcggcgtctgagattttgaagatcttcatccttgggacagagtcgactgcatctcaatggacccgtgagcaggcatggtacctcatcaagtctatcgccaattccaaggatggaagcctgttatatagcaaagtcctcctcggcgatgtattcaaggacaacggcgaggccactctccgggcactagagcaagcagagctcatctccattggaactgacaaaggattcccacgatacgtcaggccgggtaaacccgtgtatcgcgctgctttccagcgtttagttgcgaacaagaccctgcagggccgccttgatctgctaattctctcacagctcattggcaacgagaattcaagtatcaagaagtatgaggaggagctgcaggtccttggctcgctgccaaaacacccctgggagctagcttcacggattgagtggcttctgcgcaaagtccacggatcgcaatcgaagatcctcaagtacgagagtgaaagtgctgccttgtcaaagtatttgcagaaagagaattgagagtttaaccactgcgtatcgatctcatctcaatgccacattattattataaacacctcaaaatttaccagaggtatagatttgttgtcagagggaagtataaacgcgaaccagttgatatcaactttgatcccactattcatgttaatattttgagaacctctcataattatatagaaaggaatcgtagtttattttgggaatattgaaaatcaatgaaaatcaatgaaaatcagtgaaaatcaatgaaaatgaccaacttggaaaaataacaccccagaccatcgagcttagtaagctagaaaaagacaccggcctccgtttgccatcctgtccctttaccctttcacttggatatattaatctgaaaaaaaagatctttggagatcaatttcaatcgccatatccagtcatctctcctcgagcccttgagtgggtgttgacgctgtgttatcttacgtggcagggtttgttttgagcagcattgaattgatcacaaatggagaggtacggagccttgagtcttatacaggccgtccgtgagagatatttcggtataagttggtcaactgtttttgctgttgtggtgttcgtatgcatcacaacccggattatctcggggcttcagagtcgacctgatcgggattcaaaatcacagacggttcgagtagcaccgtattggtttccctggattggacatggccctgccttcttatggaatcatgttaccttctttgcaagagctcggttggtcttctactatattgtccttctacggtgcctgctaacaaggttatagagaatctatgaatgagcctgtctttggcatttacatgcgtggtgtgaaatacaatgctgtgacatctccatctatgatgaagactgttttctctgccaaagctgccacgccacacaaccaggtgctcggtcaagctctgcaaaacgtctttggcgaccgcagcctaatccgaaaaatggatttggatcgtaaccaaggagttagcgacaaggcttccaccattctcaacgaagaggatttcgtcactgaagcttcggctactattacccgtttggtgcagcgtgacatgtcgaacctggtgagcttctgccggagcattgttgaccaatgcccctgggagcgtggaatgagtggagttgaagttcccgaagaggaccagacagtctgcgaggccaatttgtttgcactcatgagcaatttcattggtcacatcatttctacttttctgatgggtgaggcctttgtggaaaatttccctaatctctcggaagatcttggaaaaatcgacgattgctttgtgacactcttcgccgggactcctcgccgggtcccgcatccagcggcttcagcaggacatgcggctagtgatcggcttcgccatatcttttcgatctttcaccgggcttttactgcttgggacgacgggattgacgccggcatcgagctacgtgatcttgacgatgtgtctgaactggtcaaagataggatgcggactttccgaaaattggaactatcgtcaggtgctagtgccgcagggcacttgtccctgtattatgatctgattgagcacacgactaagatcactttttggacaattactcatctcttcgccgaaccttcccttctcgatcaagtccgcaaggagatcacctcttacgtggtggcttctagaccaagtcgcgaggagacgggtttccccttcgatgagcctcctcgtctctccctggatattgaaaaggtgctcacatcttgcccgctgttcaaagcgtgttactacgagactgtacgtcttcattcagcagggatttcattcaagaagctggcgtcggatctgatactttccgagtcggcagaagaagccgcctatggtctgacggagccccgtacatacaagattgcaaagggcgaggatatcattgtaccccatggtgcttatcaccacgatgatcgatacttctcaaacccggagcagtatgatcccctacgatttctcgtgactgaccctgtaacgggaaaacaacgggctgatccaagtatcctcgctccctttgcggacgggttgtatgggtcgacaaacaatggatttaccgagcgagccatcttgactttcactgctggcattgtggccttgtgggatattgagcctacaaggggtgaattcctctcggttccagggcacaagactagctggggggctttccgaccgaccaaggagctgcgggtgaagatgaagttgagggtatagatatcattttatcattttgttatagagagcactgatcaatttaatttttattacacgacaggctcggataagtgtccgaatcggccttgcgccgatgacaccatccacgaagaggggaaaatatataagtcacctaatctaagctgtacctagttacctaggtaggtagttcctcgatctcgatagtgaattattcttcttcgggaacgaaaaatggaacagaatcctaaaaaggactacgatctcacaaacccaatcacttccacatctggacttcgccagggtctaacatcctatggagatgctcatttctccctctttctccgaaaagtgtttatcaaggcactcggatattcagaggatgcgctttcacgtccaatcgtgggcatcatcaacactttctcagggttcaatccctgccatgccaatgtgccccagctcattgaagctgccaagcgcggcgtgcaactcaatggaggactggcaatagaattccccaccattagtctggccgaatcattctcacatccgaccagtatgttcctgcgcaatcttatgagcatggatacggaggagatgatacgggcgcagccgttggatgcttgtataatgatcggcggtgagttccaatcgctctactctacagttgctttcctgtcatgtgagaatagccactgagagaacttaggctgtgataaaaccgttcctgctcagttgatgggtggcatctctgccaacaagccaatcctgccactgatcaccggtccaatgctgccaggaagccaccgcggtcagcgcattggagcctgcaccgattgccgaaacaactgggcggccttccgagcgggtgaaatcgacgttgaggaaatatccgccattaacgaagagcttgctccaaccgtatgtgcagacgggctttctgcagacccagggccatttagttcgctaatcacaatggttactcgtttagatagggacatgcggtgttatgggaactgctagtacaatggcttgtgtgactgctgcgttgggaatgatgccgctccgaggtgcaactgccccagcagtatcatccgcgagactgcgaattgccgaggagactggcgcaagtgcagtcgcaattgcaaaatctaagagaaagccacaagaaatcttgacaaaggaatcattctggaatgccatcacagtgctccaggctatcgggggttcgaccaatgccgttgttcatctgctcgctattgcaaataggcatccagaactgcagggagtcatcactttggacactgttgaggagattggccgcagaactccgctgttgatcgatctcaagccgagtggagataactatatgaatgatttccacaatgcaggaggcatgatggcgctgttgcaagtgcttcgacccctgctccatttatctgctttgacagttactgggcaaactctgggtgaggtcctcgatgcgtcccaatccaagcgacttgtttttgcacaacagattattcggccaatttcagaccctttgtttcccgcgtcatccttggctgttctgcgtggcaatcttgccccggacggagcggtcctcaaagcctcagcgtcgaagtatcggcacttactcacacacactggaccggctgtagtattcgagaattcggcagaccttgctcaccggatcgatgatccaaaccttcttgtgacgaaggatagtgtactggtcctgaaaaacattggtccggttggcaacccgggtatgccagaggctggccttataccgattccaaagaagctagcagaagaaggagttaaggatatgatacgactttcagatggtagaatgtcaggcaccgcaggcggaaccatcatcctccatatctcgcctgaagctgcactgccagagtcaccatttggtgtggtggagacgggggatttgatcgtttgcgatattgagactaggaagttgcacttggaggttacagaggcagtattgcagactcgaatcgagaaacggcgacagagccttgtagaagagacccgggcaagaaagcagatgagaggctaccgcgggttgtatgagcgatcggtgaatcaagcgcaagagggagcagattttgatttcttgacagctggaggtgccagcacatagaaccaatttcagatacaaattcgatataagactgtatgccctttggtcccatcgaaccttggattgattgtctggaggcccttaccctgagccctgagccctactttcttgcccgatcgggttaaatcaatcaaggcgcgtaacgcggacgcgtctgaccttgtagatccctggccatttgtgatccaccagattaagattgaacgatgctccagactttctaattgcaacctgatcgaattatttgcgtcaggcctcatttgcaatgagtttcgaccctcttcgcccgcgggggcgcccagcccgtaagtcatgctgattacctggggagactacaataattactgacaacgcggctttcacatagacacacccggcacaacgatactgacctacacacctgacggacgatggatcattactggtggctccaattcagcaattcgtatctacacggtcggcgaagatggggagcctaagactatcgacgaaggtgttgacgcgcatttcggcattggtgctacggtatgtcagaaccgaggactcaggattagccgaaggagctgactggattgccagaatcgatctttcatcatgggtgccgaggatgggacagtctggaagtacgacattatgtcgggcaagatgcaaaacttgcttgtacgatgcgctttgccggtcagggacattgcagtgaccagagacggagaatgggtcgcggtagcaagcgagtaagtatcacaagcattgtgttagacagagcattttatgctaactgtggtgggctagtgagctcacagtcaagatcgtgaaagtcgacgacatgacgcaagtcaagtatcttcgggaacagtccaagggaacgaaacatgtcacgttcgatcccagtggccggtatgcgacagtatccggaacagatggaattctctatatatactccatgcacgaagaggagccggagctagtccgcaaactcgatggggtgattagacgattggagccagacgccgaggcgacatcgagagcagtgtggcatcccgacggtactgcatttgcttctgcggaagcgactagggatatttctatctactcaacctcggaatggaagaaggagaaaacatttgctggtggacataccggcgacattacggccttgagctgggccccgaatggatctcttctggcatctgcagcgtcagatggatatattgtgctatgggaagcgaagacgcaaaatatcttgcagcgatacgactttggaaatgtcatgaacctatcctggcaccctaccaagaactccctttcattcacaacctcagacggagagcttttcatctacgataactttgtgccgaaggatcatgagcctcttctgcagaaaccgctgcaggctgctcctatcttgcccgggcctctgggcgagatctccaacaacgttgggcgaaccacactggcggaacggtccaaagaggccatccagcgagcggcgagaagagggactcctgactcgctagatgatatccttggtgaagatgaccagatgatggattttgtcgaggatgatgatggggctggctatgccgatgaagagctaaatctgtatggcaagcggccacacgatggtctcgatgatctcggctatagtaacaagcgcctgcactctggctttgagaagcccaagtcccatccacctctccaacccggtagcaccccttgggctgggagtaggagatatctctgtacgttctcgttccagtttcattgaaatggatttgctaacatggccaggcctgaacttgacgggagctgtctggacggtggaccaggagacgcatcacaccgttactgtggaattttatgaccgggaagctcatcgggacttccacttcactgatccatatatgtatgacaaggcttgtctgagtgagtcttttccgcatttctcgcctttttgtgttggatctttggctgatcacgtatagatgacaacgggacactttttgccaataacccttcggatggtagtccggccactatcttctaccggccacatgagacgtggactgcacgagcagactggcggactgaactgcccgagggagaacaaattcgaggtaagacttcaaaggtatatagtcaacctaatcatcttactgatgctcattatcagctctggcacttagcgattcatacattgtcgctgtgacgtcgaaggactatgttcgagtgtacactctctttggaactcctttcaaggtgtatcgacagaagagccaagccgtaacttgcgcggcgtggcgggactacattatgagtatcggaaacggtcctacagggattgatggccacacgaccttacgatacacggtggagaatgtcaagcgcgacgaaatttgccaaaatgaagacactgtcgcccttccggaaggggcttcgctacagagtgtgttcttctccgataatggggtaagtgacatccacacggaggagttggatatggaattgaccgccttcttaggatccttgtatctatgattcgactggcgtcctactggttctgcaacactggcgcgcacccggccaagcgcgatgggtaccactcctggacacgaagcaactggcacgtctcgcgggaggacggaaagaagaaacatactggccagtggctgtcgcacaagacaagttccactgtatcattctcaagggtggcgacaagaatccttacttcccgcggccgttgctcagtgaattcgacttccagatcccggttgccagcgctcttccgaaggattccagcgaatctgaagacacagcagccgatggtgcccgtttcgaagaatcattcgtacgtggaaatgtacttttgtcgctcttccgcgaccttatctcgtcgaccaatgcaacggcaagccaacgctcagacttggcgcggagggagctcgacttggataagaccttgctgcagatgctggccattgaatgcagagagggcgaggagcgtggtatgaaggcgctggagctggtggccctgatgacggaccgcaacggtaaaatgctcgaggcagccgctaagattgcacagcgttatggacgtggtgttctagaggacaagatccgcgatctggctgaacgacgtgtcatgggaatgggagacgatgatgaactggcttgaggacggggattcttacgaataatactttttcaaattagtcggaatcagagtagatccgtagatttataacattctcatgaattgtatgaattgtactaactatgtagtgaatgtagtgaatgtagtagtggatgtcagtataaaattgtataccagagcatcctgattggctctcgcaacgtcattttccccgactccacgactcccggactccgacttcaaccttcaaattatctacatggcttgataacgatactaagttcagtctgcttttgaaatgcagaatgccgaagctggtttctctgcgaacgtctcttcccaatcagccgaagagttctgtctctggccggctttttgcttcggtttcacgacaacgactggcgcaacttcgtcatggccttctcactgagccctggctacctccagcttcagctacacctctgccaattacatacttctccccggcttgggtacgcagggagcatggggaaggtcctcggagaaccgatcacaaacccccagatgaaaggaccttgaaactcggaaagagtatgtactcactatctcattcatcttaaagaaaaaaggaaaggcagtcgttcaactaactattaactattaaagctttacgaaccctctcccccctcttgccaaccatcttgtacaacaccttacccaccgaaatcctcgctccgagtgtcaaccttcacctattcccatccacacatccacacctccccaccgtcaaaggacgcacactctatcgcgcggcactatggactgtccccgtagcatggagtagcgtaccactggtcggcaacgtgaaattgcaaattctcagcgaaaggatcgtacgcgccgggacgctgctcgaccccacgcatcacggtgcccaccacgactgcggcgatgagcgcctactggtacgatggaaaaccgaaccacgaacagacagccgccccttccacggcccggcctctccgaataccaactctaccaactcgcaaaccgccccatcacaaaatagccatctctcggcttctacaaacggcactaacaaaggcttgagtgtccttctcggtggcgaagagcctattttcaagctgtcaaaggaagagcaattcacgggtatctttatcttctccttcgatgaggagggtcgaatcctgactcataccatcgagcatgccgatgaagcggacggctgggaccggactgctaaattcgtgactctcactgactggctcattggcaaagcgcgtggctcgttggacccagctgccaataccggacttgccatggcgactggtcaaaatcaagggtttgcttctgacggtggccggagaccatgactgcacacgatcatacctcgagcgaatttctcattaaatgaaaaatccccaaggcaatgaaaggacttgcgattaccgctgtgtccgtgtactctctcccaacttcttggtgtattgtggggggtttttttttttttttttacttcgatatctcttctggattcaaggcgcaacgatgtctggtcatgggtattgaatgatggggcgttttggcattgaactcctctctttcacttggccttgtctgctggcatccttgagacatactatcgccactcttctgtgtactataccctattacggactaagaaaagacccaaagcaatggtgaaatcacttgttacatatggagaagactttttctaggaattgtgcctttcaccaggttctacagcctgctagtcgttatcgttcaactatacgagaaaaagaatttccaaactgagtgaagagtagcaagcatgaagacaaggcaacttgagcataataatcattggctttctacgaaagaaaatgagggagatggggaggcgtttcggggctgatactgttctctcagttgatataacaaaaagaatagtgagacgctgggaccatctttactttaagcatgcttggtacaatgtccctctgtgtatctatgtacattactcggtctttttgtgcgcagcaggagccttcaacaagccgaaagccgcaactgtgacgacacacatggcgaacccgccagtagtataagcagcctcacggccagcccaccaaaacagggagcagaacacaatagggccagtcgctctaccagcctgcccccatccccgtaaacgacccataacagcgccgcgatccgcgtcctgcgcctcgaagctgcccaggctgttgagtgaggtgacaaccgtagcggtcgttaccgccaacagagcacccgcagcatagagaccagagggcgaagaaacgtgagccaggcagaagaatgagatagtacaggccacaataccagcacgtagggtgaccagcggtgggagacggcgcaccagcgtaccctggaggagggaggcgatcaagcccattagggacaaaagacgtccgttcaatgcagcagggctagccgtcgcggctgattccccgtatagagtggtagtgaggaaggggagggaaaactccagaccggagaaagggagcaggaagaaaaagtgtagggcattgagaagggccgggctatttgtatggatgcgcttagcggggggacttctcttctcttctgtctttttacttgactcatcattcttctcggtggacgtactctcgccctccatctgaagagtcgtcaagcggggatgcgtctcgggcaagcaggtccaaagatacacagtctccataaagatcagagcaaaagaaacaattgcagcgacaatgtacgggttctcggcaaccatattgacattactgagcgctgcacctagcgccggcccaaaagtgaacgcaacgctgaaacaggccccaattaatgccatagaggagccgcggcgctcctcgtctgtgatatccgccacaatggcattggccatttgcacatttgcttcgctcaagccgccaacgatacgactggcgaggaatgtgcggaaatccgtcgccgatacccacagcgcgacgctcaagaggttgcctagcatggagatgagcagggcgcgacggcggccatgacggtcagataggcggcctatgacgggtgcagcgaaggcttggaggagggagaacaaagagccgagggcaccaccgaggagtacaatgtcatagcgcgagtcaatggggcgcgcgaaggagtttttgtaggcatttaggtagtggaagatgcggttgaggagggaatccggggacggatcttgcatgcgatagaacgatagcagcgaagggaagaggggcagaataaatgtaaatgagatctaaaggcgttgttagttgagtaaatgtgattgttggcttagaggggatttcttggtgttaccaaatctaacaacagtgacagtatcaacaccttcagcacctccttacgttgggcgccagcgacggccatggttgctggcgccgtatatacaatggaggatgtaaggagggagaaaagaagcaaaaatgtgcagaatgacaagatctcgagaagttgacagttgtacaagagtacgaagatcattttaatcagatcgaatacgccagctccactgacatttcctatcgtgggttagcgcctttctctgaaaacgggtatccaaaaatgcgctagtaaaaaccaaatacgctcgaaaggcgtatttggttattttcattagtccatgtataattgcaccgaatttgattcggtctagtgtaatagcattacaattacgctaatgcaatctcggctaggatagtggagaggtggaatcacgtgatacagcagttaacttctaggtagttactacgaccactactactactaatctatatacatacaacagttacgtatgtacataactatcatcagctacatatgtatcgactattgtccaactattcaagcaatagacctagtaaatatgacttcgtccaatgaaagagtcccatattgaaaggcattgttgttatctagagcaaatcctggaaagtaatggtgcactcattatgatcaatttcgatctatgcccagcctaagcctgtccaccggtccattcgcaagcgccaataaaaacaatagccatagaatacatatgtatgtcatgagagaagctctctggggatcgggaatatgcacgctgaaaagaaaattgcaggacatggtcaagaagactttggcaaagccagacgaagagatcaaagcgactctccgtgaagaaaattcgttgcattcgtgagccatcacatcggaccagaaattgtcgaggccagtcccgagaagacagacccagaaatccctcattggaacatcaatttggagacttactccccaaactagcatgttccaactaacaccctaggattgccactcttactcgctggaagcaggagcttccaccgagccagaggcagggccacttgcaccgcctcgaccacgtccgctacgaccgcctcgtcgtcctccacgtccacgaccctcaccggcacgagtctcaccaccacgaccctcagcacctcgaccctcaccactgcgaccctcaccagtacgcttagcgtcattccggcctcggccaccacgctgtccgtgacggcggcgtccaccagacttggcaccgttctcaccctgagtagtaacatcagcgccaacggagccattgttcaaacccgcatcagcgctagccggggtagcctggaggccagtgtctgtctcctcagggttgcgaggaagcttgacccattcactgctctcatcggaagtaggagcccaagtttgttccgcaatagggtttccaccgtcagaaaccagagtctgggtaggaggggccacctgttcagcttgggaagctgcagactcagcctgagtgccgagggaggtatcctggagctccgtcagaccggcattagccatggtgggatcggtcgtagggtcggtggcgtgggttgcgtctggggcaacttcgggagtctcgtcgggcggggcgaacttgtcagatgcttgcttcacatcgccatctaaatagatataatgtcagcgagcacatccaaggatatttgattggggcgggggtggggggaggccttcgttactgacaggtaaaatcaagagtggtgccctcaacagtattgaccttctcatcggcaccctcagcaatcttcagtagcgaattgactgcagattgattgccagcgtacacctcgaacagaacaccctcaaaagcacggctctcagtgctgacggcatcgccgtcgcgtcgaaggatggccgcggcgcacaagaacttagtcacggtatagaactgctggcgcagtgtcttcttggaggcctcagtcgcatcagcaatggcgttattacggacagcttcgagctcctcctcatgcgccttgacaagcgcagccttttgagcagccagacggtcctcgtattgggcagcaaattgcttgtagtggccaatctgctcctcagtctgcgcgacggtggcctgaagggaaggcttcttaaggacctgggccttctggtcgttgttgatcttcttctcttcaatcaggtcatcaagcgacttgtcggggttttcggcgatgatagcatccactttgccgagagagttctagcaaagacgacagcaacgttagaaatgtatcgaaagaaacagattgtaaccaaagagcattcaataatgactcaccaacttcttcatggcattgcgaagtgtcctaaacggggcatacagttagctcacttccacttgcgcattggcaatgaccatgccaccaggttcgttagattttaaacatacttctgcagctccttcaagtaggtattctcctgaacatcacagttaggactctcggggtccttggagacgcttgaagaccgggagcccttctcctcgtccttgagcttctgggtagcggaagcgggaggcatgatgggaatgtaacacagatattaaagtatttctgaaaagcttgtacaggtcttgaagaattaaacgtgataacgttgaagaaaagatgggttgttatgaaggaagaatcaacatgcgggtcggggaaccccttcttggtcggtgtggcccactggcttggggcagactctctctctttctctctatgcgttagcacaaagcaattaagcaatcatagaactggactacgtctataactgcgcaatttaccagttaacagatttgttatttgattttcttccattgtattgctccagggtatcatattcacattcgcccacaacgccataatatcacaaaatgcaggccaaccttagtacagtatctatcccccctcgcctttcatatccatgctaggcaggtcttcgccacaatgacagatcgaggttcatataggttcgtatcatgggcttttctatccctggaacctgcgcagtgttttctaaacccatactttgtcagctgtgtgttctcacgtctcctagaaaaagctcttagatagacctcaaacaacgcacctcggtgactttgcgcacggtattcgctgagatattcttctcgccagacttgcgtgaccgaatcgatgcctcgcgcattaacctacaatgtgtcagccccatcgtcagatcaatcatgtcgagaatgcgaatcggagggttgcgaccggtggaccaagccagaaggatagatgaagacgcactcttgcatgaatagtatgtagtccaagaagatctttaaagatagtattagcaactggataatagagaggcgtcatatagggacgaccgcgtaccaggatgtcggcattcttgctcacgctccgattggagtgggctttgacaattcgcttgactgttcctcgtggataaagtttctgaactgccataacgattagaatagagaagatggtgaaatggaagacgaggtgttcatgttcaatgtttccccccaaagaaggatgtggggagctctcgaatccgaccgaataccgcaatgatctgtttcttatgtaatctggtatttatacctacgtacctacctacctaatgtatatggcaggatgtaagtaaatcttcatttcatattatatacaatcttcattacaactgttatataacgtacacttcaacgcagtcgtcgaagaatgcgccaagctgaaataccagcaattgatccaatgacgacacgccaggccaggaaaacccagattgccatgcgcaagcggtcataatacccgcgaagcatgatcccaacagcataagaagtcccatctcttgcttggtctgtcggtccgtaatatcttcctaccccgaggccaccgatgcccacttcattgtggtcatgttcaacattcgtctcctgtgtgactgagagtgcggccgtttcgctatcagcggccgtgttactaggacgagcacccgaccttacattgagtgcattacgcttccgcagattataagtaacgatgctcacaatcagccgcagatcaggaacggtaaatgttggatatttccacaactgcacagcctgatggggagggagcatatccaagaagtcagccaggatgccgagtgtgagaccccagaggagcagcgggcgggcagtgtcactcgaatccgcttgcccacttaggaaccaccccttgaagcgctccatcagggaaggtttgagtatattctcttcaggaacaaatcctggaattgtagtgcattgatgagtttccgacgggaggagcctcacggccgagaactgcatccagcccatcagagacctgattgcgagacgggtcagaaacccgccttgtcgagcgaagcgctgggacatatccacatattccacagtccgcagcgatggtgataggagagcgcgcaggggaatccaatgtgtcgacgctacttccgtgggctgcaatcgaagggtcggggagtcgctgcgagtcgtgaggaagacgaagggacaaagaaccatcaacctgccattcaagtcagtaacccaattctcagcggcgaaggtgaatgacattcgtacggttcggacccccagctggtagtgaccacccgctcagggagattccccacactaattgtatcttccgttgtcagatctaacccaatttcctctgaagcttccctgatagctgcagccttgtcatctacatcctccggatctcgctttccacctggtagggcaacatggccagtccatcggtcccccacgcgcgaagcacgcttgatgaacagaacctccggttcgccatactggacccagggctgtgcaaagaacccatctaaacgttgttggactgactgcgaagcattgtttgcgaggttcgtgctgggccaatggtcgtaggttggtcgtacccgaataatcaaggcaaccgaggcgcgtttcttgcaggttgggggatttgggacgtaaggataaggttggcgatgtagctcggttaatacgccatgcagatgatgcgacaggcccggagctgcagacttgggctccatcaagttgtatagttggtacggagtactctcggtatgcaatatttagatgtcaaaagggctggattgtggagggtatcggtatcggacaagcccatgtgcacgtgcctccttccggtcctggcgggggcgatatcggtctggcccgtttactccccgtactgtaggtacctaggtgaaatacatccttacataatacgctcggaacatcaattatccagatagctagtcatcccccggtccactgatgggctctgattggcctcatccaacgagcacgtgcgtatatcgctggctacgaatgctctcagtctaaagctgctgcatgtccatcgcttagcttcaagctaataagccaatttttttttggcgtctgcgcatatctttcgatctgcagttgaatatcaactcttactttgcttttcattttctaaagttcgatctcaaatcctctctcatctcttccccccttccaacttcccccccaatcagaggtgcacaccggccagctctgcgtaacacattgacaacctgactggctcaaaatgcggtttggaaaaaccctccgtgctgcggtgtaccctccctggaaagggaagtacattgactacaccaagcttaagaccttgctgagagagaatgatgtcacccggaacggagaagacgccagtgactcggacgacgatcaatggactgagcaagatgaagaagcttttgtgcaggaactgcttaatgtagaactggacaaggtaaattctttccaagcagagacatcgcagcaactccgagaacggacaacagcatgtgaagttaagctacgacccttggcatctaccccggagcaagaaacgccccctctcaatgaacagaagaaaagggccattgcctcagaagttctgcaagaactcgataacatcaccaaggaagtcagtgccttggaaaagtacagccgaatcaatttcactggtttccttaaggctgcgaagaagcatgaccgcaaacgaggagcccggtaccgggtgaaacctttgctccaagtgcgactgtcgcaactgccattcaactcagaagactattcgccgttggtccatcggctctcggtgatgtactcctttgttcgagagacccttagccatgacatcgtgcaaccaagggagacagagcatggatttggccgcgagacctattcgtcttacaaattctgggttcactccgacaacgttttggaggtcaaaactcacattcttcgtcgattgccggttctcatctacaggccgggaacttccaaggacctcgataccatgacagaagaccccaccattacttccctctatttcgattcccctcggtttgatctctacaaccaaaaggtcgcacgagcacccgaagctggatcgttgcgactgcggtggacgggatcactaaaagacaaacctgctatccagttggaaaagaagattgtcaccgacgacgacgaaagtcgacaagtcaaggtacagctcaaagacaaacacattaaggaatttttggacggcgagtatcgctttgataagaagctccaccgcatggaggattcgaacaatggagattcggcggccgccgaagccttgaaaaaggatgtggatgagctgcagtcattcatcaaggacaatgacctgcaacccatgctccgggccaactacacgcgcaccgccttccagattcctggcgatgatcgaattcgtatctccctcgataccaaccttgcactcattcgggaagatgccctcgacagtgaacgtccatgtcgcgatccagctgagtggcaccgtaccgacttggacgatgctgatatgacttatcccttcaacgctgtcaggactggagagatcactcgcttccctcacgctttgctcgagatccagcttcgaggcaaggcccataataccgagtgggtcaaggacctgatggtctcccaccttgtcaaggatgctccccgcttctccaagttcgtccacggtgttgcctccctatttgaagattatgtcaacagcttccccttctggcttggtgagcttgaaagtgatattcgtcgtgatcccgaaactgcattccatgaggaacaagagcgactggctcgacgagcggaggagaacattgctgtgggcagcttcatgggagacgcgcgtagccccagtgttcacccactcgggtcaccttaccgatactctagtgcaggctctccctcggtcatgcggagatcctcagcagtcaccgaacctgcagcgcggcacccacgcccctctgtcgcagagccccagcgccgtgataccgaacccgctcccgaaccagaagagcccgagccgcccactcgcctcgagtccatctttcaatccttgggcctatctcctcagcgttggcttggaacagagtctgtctctctgccgcctggtgttcgacaccccggcgtctggatcaaagattccgggcccgttcgcgtggagagcaaggtttaccttgccaaccagcgaacgtttatcaaatggcttcacatcagtatcctcctgtcgagtttgtcattgggcctgtacaatgctgccggcaagcacaaccaagtagcccaggcactggctgtcgtctacacattctttgccatcttcgccgcggtctggggatggttcatttacgagaaacgggcccgtctcatccgccagcggagtggaaaggatctagacaacatgttcggtcctatcgtagtctgcattggcttggcagttgccttggtcctgaactttgtctttaaggttagattccccagtcgttttgttttaacccggccttctcgctaactcgttcaacagtattcatccgcactaagtcaaggccgcaagcacccacttcctagtgtgtctgttcactctaactcgtcagttgttttcgacagcagctcaggaggttcgtggggcaacctgaaccaggcgcagcaggttctgtaatagtctttccggggctttttttatttggacatgtggccaatgaaccccatggctggcctttgggctatcaggccccaactgtgagcatctgtgctttagcgtagttgttgagcaatagcgtgtacttcaaattaacatctttctggggcacttatggtttatatcaattacttctcttgtccaacatgtattcatgtattcatttatgccaaatacatgagagctcttagaagattggcgatccccaagacatacagaatccaaacgcgggacctcgggagtacggaatagcaacgcttacaaatcgactgtcatccccgacatcccaaggacaaagctccagaagaaaaaaaaaaaaagggttcgagatatcccaaatttaaacacgtctctctctatttcctcggaatcgacatccttgacacaatgacgaacttccaggtccagatcatctcagacaccatctgtcccgtaagtattacaaccatatacggatctacacccattcatccatatcctccaattccatataatccacatactaacaatataaaaaacaagtggtgctatgtcggctaccgccgcctctcgcgagcaataaccaggcaccaagccacgtatccagcagacacattcagcctaacctggaaagcattctacctcaacccggcaggagccgagtatcccggcgtgaacaaagccgagatgtacgcccggaaattcggggctgagcgcatggaggcgatctttgcgcgcctatctgctgtgggcaaggatgaggggatccagtttagtttcggcgggaattctggtctcacgcgggactcgcatcgcttgctttggttcgctgggcagcgggaggctgaagaggctaagaaggagggtgtgaatggcggtgttgttggtgggttgcagacgagggttgcggagcaactgtttcgggcttatttcgaggaagagaagaatattaccgatttgaaggttcttctggaggcgggtgttggggcggggttggatcgagagactgtgaagaagatgttaaatgaggatgttggtgctcaggaggttgatttggaggccaaaacggcggccaggaggttggtttctggggtgccgtacatctcggtgcaagggaaatatcacgttgaaggggctgatgaacccgaggtcttcatggagatctttgagaaggtgaaggccgagcagaaggaataaagaacatcatcaggagcccaatcagaatgttctattgattcctacactggtctcattgctatggtcgtgtgtatagttctatcgacatgccgtagcaagtaaagctactcaagactatcaagcaaaggcgctggttttatctcggtacatttttgtgtcaaagatatctgcacgaaaatggaatgtcgaggtagacacgctctcagtgacctgtcacttccagctcataaagctagggtgagcatcccaagtcatgaaagtacacagattaacgcctgtcatgcaacgaatgtctgggtcatctgtcaaaaaaaaatgaagtaaaaaaaaaaaaaaaaaaacaccccggaaagaacagtggagggggggaaggcatagataatacatattcaagacgcaaataggaaataaaagccaaggatacagcccaggaaaaagcagagaagtgaagaacgtaaaacgaccagagcctaaaaccttggccaagtcattccacaaatgaggtcatgatagatcgtagcaagtcatggaattttgaactccatgttcaaattctaggggcatttagtgggtcgtctgtgctttgacctgatgcagttcataattgggaaggtaatcgaaccagtcggtctcgggattgtagcggtatgccttgaactctacaccatatggcttgggctcaagcatgtacaaaacgcccatcgggacatcgaggtcagcgacctcgtcacgcttcaagccgcggaaataggccaggagcacgcgagcaacggatctatgcccgaccaggagcacatggtctgtagtgcgctctacctcgacaataaccgtacgcgatcgattgatgatgtcgaggtagctttctccacctggtccggggtatcggtagaagagtttatctttcttgcggtgggcgtactcctcggggtactgctcttggatttccttgtatgtcatgccttccatcctgccagaatgaatttcgtccagcatcctcatctgtttgacatcgtactcatcctcgttgaagtattcagctgtttgaacggagcgttgcatcattgaggaccagacacagaagttgcgtggcccttcttgaggaagataagatgggttgggaggtgtgatgtcaccggctcgaggcgggaagtgcttgagaaggtctttctgtcgctgatatgcttcccactgcttccgctggtgatccacgaagcgagccaacgccttggcataccttctgccgttctcgctgagatcagagtcaccgccaatacggcctgcggcatcatccaaactttcgccgtgtcgtgtgatccaaatttggcgtggagagagattgaaattgagcaagtagtagacgacttgagaagcaaggaagccatgggtttggtgagcgacgactttacgaccgacatcgatcatctgaatgaaagccatacgatgcttctcctcgtattcgccgagaggcacgtaggacttttcgtagagagcaacacgcttcttgaaatcttcaagtgcctcggttgggtcctggcctttgtagtcgggaccagaaagtttcagtcgcatgttagcctcaagcaaatcctgatccacgcaactgctctcaaggaacaggatatttagctcgggaccagcgcggttgcgaatatggtcaacaatcgctttgcgacgttccatagtgctgttggtcgcatcgaggataccaatactgccaccttcctccaaaatataatccaacaattcatcaagagtgtccagggcgacctgctctctcatcttgacggcacgctgattctgagggtcaaagaagtcggcggtttgatccataggttcgggggaagcttcattgatagcttcttcattctcacgagattgtgccgggcctgcgtcgatcgagggcacaacagtactttcattttgagaatcttgttcgggctcttctccattcacgagaatcttggttgggaccactggagggggaagcggtgccccgttctctggcggggagacgtctgatgagttcaaagtggtgccaacgctgacactcaaccgacgcactgagtcaacgagatccttgtggaaagcacttggtttccgatcctggccacgatcaatcggggcaggtgagggggacttcccagcggccacacggcgacgctgtccaacattgaagatttcggtgtcatgttggagccagttcaaatagcgggccagcttcttggtaatgtaacttttgcctcgggccgggaggccgaccatgacaatgaccagcttggcgccgacatcccgctgggcaatgcggccatctggagataccttggacttggtcaatccggggatatcgagagtagttgctcgcactcgaccgggagtaccaggaggttgataaaggcccgatctgcaaggaccccattagtcaccgtttgccaagcacatctaagcaagtcccgagacagaaaacgtaaaacaaggggttgaatagtccggggtaaggtagattagctcagaataaggtgcaaagagccccagaactggacacatcccgaagcgagccgatcaaggctcgttctgataggctcagacatagtaaagtggaaaggttctagacgaaaatcaacaagactcacatctgtggagacggtggtgcggtagaaaccggagtgtccgtcaaagccgttccgactccgcccttgggcggcagtgaagatttatgggaatcggaatgcaggtcgttacctagcgctcggttgaccacagttttcgtaggcagaagagctccttcttttcccgatcccgagccattagatgtgccgttgggtttaatattaatcctctggtcccccgtctcaggtgaagtggccgacgtcatggccgaccgggcaatgctagaatgttgcgccatcccactgggggatgttctgtttgtttattaagaagagtatcgtctcgctcttttcagagcttgttcacgagttgtctcaaagttgataaggacttgagtcacacctgggcaactggaccaaaaaaaagttggtgagagaggggaaagaaaagaaagtgtgtccacggaggtttggatgagtcaaccaacgggaccagggaccaccgggtctgatattgaccacctgggatagtcaaggggatttggaatattcaaggggttgaaagaatcaaagaggttggcttttttttggatctggagtttctttttggtgcaaatatatttttttgtatttttttttttttttgttttgtttttttcttcttcttcaacgtgtggggaatacaatatcactctcaaggacagtgccaaggacgtcaaagagacctttaaagaaatactttgaaatgatgaaatcaggatgcaggttagatttagttcatagggtggatcgatggcttaaagatcggccatatatgatgtcaaagtgtatacaagctttgggaagatagcaagatattcaagtctaatacgggattaaacagatcttatatatacatcatagacacaattgggggtctcacaaaaacatgcaagatgtatcggtcctatctgtaatagagaatgcttggctaagagtatacagattcgaagaaaaccatactcaatctgactcctgtgtactttgccctgcaatatcctcataacccaccgaaatgctcatagccgcttgttttcccgtcttggtagagtcttggtagggggtatcagtactccgtacaccttcagttgattccaattatggccggctcaacaaaagcacacataatactccgcatttggaatcgaactcagcctccagtgaatcaaacaacactaaccattgagacaccttgtgtgacctgagtctcaccgctcgggttgatccatactcggcttccttggcgactttcggtcatcaacacagcagattgatctccgaccaactgtaggcgtccgttgctgcacaccgatgtccgctgccgtaagccccgaaaatggtaacccatattccgtggtcaggtgcggaatccttggcgcttggcggtaacgcagggggtatcacagatagcatgcctagaagataggctccagggatattagacatggtggctggatcgcgtgccaccacacagaatgtcccttatcacttgctcaagtccaaggtcaagccaatcaagcatgcgtatgccgcaatactcaatgctgtcaagaccaagaccgcatttccactggtacggaatttgtgccgatggatcccatcctcccctatttcagagaagaactgtctgtttccctgcgagcggcggaaaagtccgatgatgagaacacccgtgccgtatatcgcgaacagagccccaatactgtagaactcggcggtgaagatcttgagtacgacgagggcgaaggagaactgagaaagggcggttcggacataggccccctcaaaggtgcgttgagccgcgcgcatctcaaccatttcatccgaggtcagcacagccgagcgggctcggtgcattcgaaggcgataacgatccgctgcacgacgctgagacggtcaatactacgagttaaggtagagagatgaagaatatggggtagaggagatattacagtaaacacacctcaaacatggttgaatctcttaagatcaaatgaaggttaagagtcaagatattggggaatgatatccggacttgataatttcaaggaagttgggttccgcaggagattgagatagcggacacctcacgtggattggaggtacctaggtacctacatgtatgtataggtgcctataggtatgtaggtacactatatatattacaaaacactatatgctaaataataaaacaataaaacaatctatcctattttctctccttctttacatataatacatcgaatattttccaccaataacgtgataccaattccaattcctcggcaattgaaaattccccaaaggaaaaaggcggccatgttccccacactctccagagtcgatgtatctttctccaatttacttcttttacctttccctcctcttcccatttcctctcgaattactccgtctcaacctctatagaaaccatccactatcacccaattcacccttgcggcgtgattgagaatgacgaaagtattcgatgcagcagaaggtatgagtactccgcaccgctgtgaacccccacgcgggatgtgtcgactgactgaaaatagtcgcaaagcataacacttctgagagttgttgggtggttctgtacggcaaggtctatgatgtacgctttcatgctatacgatcctcgttgcgcattgcacattccccggtcatgtctgattccaatctaggtcaccgatttcttgggcagccaccccggcggtgcaaagatcattttgaaactcgcgggccaggatgccaccgaggagtatgatcctattcacccgccgggtattttggaggaggagcttaagcccgaggcatgcttggggacaatcgatgctagcacattaccaaagcagcagatctctgaacctcaagaagagatcgagggtccaccacctatggagaatcttctcaatttggacgagattgaggaggtggctactaagcaagtgagcaagaaggcctgggcgtactattactccgcgtccgacgaccagatcagcaagcgctttaataatcaggtttatcggtccatcctcttgcgacctagagtctttgtggattgtacaaagtgtgagctggacacgaccgtcctcggccataaactgaaaacgcctatttatgtggctcccgcggcgatggcccgtctaggtcacccgtccggtgaggccggtatcgcagaagcatgccgtagctttggagccatgcaaatcatctccaataatgcttccatgacaccagagcagatcgtcaaagacgctgctccggatcaaatgtttggctggcagctttatgttcagattgaccgcaaaaagagtgagacgatgcttgcccgcattcagaagctcaaggcattcaaattcatcgtccttactctcgacgccccggtgccaggaaaacgcgaggatgatgagcggacggggatgaccggacggaccgctgccgtgcccagtggcgtgaaagccgccgagcgcgcgtcagacgatacccccaatccaaccgaaggatctggaggtgtcggccagcaattgttcgcaggcaccgatccttccttgacatggacggatactttggcctggcttgctactcagacggatctgcctatcgtattgaagggcctgcagactcacgaagatgcataccttgcatccctccacactccccaagttaaaggtatcattctctccaatcacggaggacgcgccatggacactgcccctccggcggttcatactctcttggagattcggaaatactgccccgaggtcttcgacaagatcgaggtgtatgtggatgggggtattcgtcgcggcacagatgccgtcaaggctctctgcctaggcgcgaaggcagttggccttggacgcccggctctatggggcttagcggcgggtggagttgacggcgttcgtcgaacattgcagagtaagttgactgggtattcggtctgcttctatttctaactctgtgatagttctgaacgatgagatcaagacatgtatgcggttgcttggagtcgagcgggttgatcaattagggcttcaacatgtaagtgtcctctcatcacttcgtcttttcttctactaactcttctcttagatcaacacgcgcgttaccgagcagcagatctacgatggtcctactgctctcgaacccttacggcgcgcattccgtgcgagactgtaagaggagcaaccaatgttatatactccaaatgtaaatgtgtttatcttcatataattcgacactttcaatatccaagaatcttttctcttggtttcgccccgttggccgttggcccactatccacgccaccttagcccatctccacccccaaccccttctcaggagagaaggggaaccaaaaaaagagaaaaaaaaatagtttccctgggaatcgaacccagaacctttccggaacacttgcttgaagcaattgttaacggaaaatcataaccgctagaccaggaaactgattgatgtgagacaatgcccattatgcgctgaaaagacttctcgccattttctaaagccattaatatcctcctgggcaatccatggatgatcaaaaacattattcatcaaaatatcttacctaggtataaatcttcagattgtcttcctattataaattaaatatgtatttacctaggtagaattggactgttagtaatgtacatatctacctaggtacttaacattaccaaggtacatcccgagccatctattccccgcatctcactgttccctttctcaatctcacaatggctgcgaacatcctacaatggtttccacgtacaaccgctccgttcattgctaatgcaccaatgtttggatttgccgatgccggcctagcaactgctgtcacaaaagccggaggattcggtataacaaaccggcctggttgcagatatcagactgaccatctatagggtttattggcggaggctttgatttccgatctgagtccacccagctcctaggcctggatactcttttgacgagtgcccgctctgtccttggtttgaccgatggccaaccattgccgcttggtgtcggtttcattaccttccagccagacgggtttattgacaatgccattcccatactccagaggcatcgagtagcggcagtctggctgtccttccctcaggctgacgccgatcatcttcctatgatacaggccattcgaaaggcccgggagagttctgagtgggatatcaaggtttttgtccaggtaggaactgtcaaagctgcagaagaggcacttcggcagggggtggatgttctagtggtccaagggaccgatgcaggggggcatcagtgggcccagggtgctagtttgatatccctcttgcctgaggtgcgagaccttctgtcaaggactcggagtacagacactgctatcctggcagccggtggcattgtggatgcgaggggctgtgttgctgctctcggcctaggttggttgttccgtactttattgtcgtaactagttgacaggaataggtgccgatgggatcgttatgggcacaagggtacgtcttgctttttctcagtcatggggccttgctaatcgggtctagttcgtcgcaacctcggaatgccctgcgccgtctgagattaagcagaccattgtatcggggggtgatggtggagtctcaaccatcaagtccatccgacatgatgtattccagtcaaccgatctctttccgaggcagtacgatggtagggctgtcatcggtgctagttaccaggattctcgggaaggggtcagtgatgaggaaatcatccgacggtacaatgaagctagacaagctggcgggcatcagcggaggacagtatgggcgtgagtatgcttctattagtctcatggggttttcgtgttaatggctttgatagtggtgcgggtattggaggtatcaatgcggtagtctctgttgagcatgtcgtgcagtctactcaacaggaggtgaaggtgatattggagcggttgagggcaagattttagctctatatgcctagtatttatttgtacgtctcctcttgttttagtatgaaagcaagatgtcggtcttatatttgcaatatatacggacctaagtatatatacttgaacatcagaagcagcacaaactacaccatgagaacaaggtcaacccagcaatcaatcaccaacccaaacacaggcaataatatatataccgtcaaaagtagaaattgggtcaggtcgagatcgacaaacgccggacgtaggccggactgactatctcccccctccccttcccccctctttatcctcaatctcaattctcaaatcctcggcatttgaagtgactgtctctacctcttagttttctctcccacaatcacacacccttcgagcaaatcaagattcacggccgtgtttggtcagccttgaagttgggaccttggtgttcccttctgagctgcccgcgatttatccctcgatttattcccgcccgcccagtcacgaatacaacgtcggatcgtggatttttaagtgggatgtgcaagaggatattccctacttctacgaccctcacaatactcgacttgacacccagggacggccaattcgcgatgaataagactacaccctcgccgagcccggtccccaaagcctccccaggctcgaaaccctctccctcgccgaccgcaggcacaaaacgcaagaggaatgctgcggcaaaatactatgccgtcaaggcgggtcacaaaccgggtatctactatggatggaatgactgcctggctcaaataacgggattcaagggagcaatttgtgagtgcgctcttcgcagtggttcttccaataggcgtgcaaattaggccagagactgacacataacctcttcagtccaatctttcccctcacaagaagcagccaacgcgtttttgaatggtacgaagcccccggtcgaatcgcagagctcggagaacacacgattctatggaatccaaaggggccgggttactggggtatacacagactggacaacagcacaggagcagattcgtgggtttccgcgacctcgatatcgcaagttctccacccgcgaagaggcagaggagtttgtacgggaaggacagacgcagccaccagtggggttcggcgtggcaactgggcctcatgggttaacgaccgagaaaccgaaagacgcagaaggggtcgaatttgcgccaggcgaaggcccactgccgaaaggagcagaagatgggtttgacccgaacgtcattttagacccagccactggcaaggtggtgtacaagactgccccccagatggcagcgacaaagacacaatcaacaggtatcccagggatgctccggatatacactgacgggagttcattaaggaatggtactccactagcatcggccggggtaggggtatactttgggcctggcgattcaaggttcgtatatgcccccatatctatattttccaccattccttctaactcccgtcacttatcccagcagaaatgtatcggagccactaaaaggcagtcgtcaaacgaaccagcgtgctgaattgaccgcgatccttcgggcgattgatattgcacctcggcaccgagatgtaaccataatcactgacagtcgatattcgattgactgtgttactgtatggtttatcaactggcgtcgcaacaattggatgacccgggacaagaagccggttgagaacaaggacctggtggaatcgattttggtcaaaatcgaggaacgaaatgaccttaaggtgaagaccttgtttgaatgggttaaaggtcataataaagacccgggcaatgaagaggccgataaattagccgttgatggagcccaaaggggagtatctgctaaggtaggggcactacatgtggcccaagaggtgccggatgaattgtttgatgaagatttttaggcatgtcattgcgaaacaaaagagagagcatcctgcatctgttcgaatagtgatatagcgatgtgtagaataatatacctcgataagtcaattgatatgttattgttcctattgttcctatgtaaacatcgcaagtcagatgccaagacttgggatgttttcccacaacgccagagttctctcctttttctcctcttctcttctcttctcgtcttcaccttcatagcaatacggatgctaacatttgctctgaaccccatttcagtacatccagatatccagatgaacttgtctacaatcaaacaggaaattcaaactatgattcaataacatttgcttgtactctcgttcagccttgacatacagacacttgtctaagactctaggtcccaactgatctgactctgttgaatccgacatattcatcttagttaacacacttgggctctcatcgccctcaaatacaactcagaacattttcaagcgggatatagtgcagaccaaaatgccgacactcgctttgatcgacttcaacattgtctgcgcgacgctcgggggctttatttccctcttcgggctagtctcgtacctttgcaaggagcagttctacctatccgaagcatgtaagcgttaagttatccgagtggtatcaccacatttgctaacaggaaatagtaatctccctgctagccggagtattattctctcctcatgcagccaatttcatcagaccagatgactatgcactccattcagaagaaaacctggaggcaatcactttgcattttacccgcctagtgctaggtgtgcagctagtcctagccggagtccagctcccaaagcgatatctgcagatcgaatggcggagcctagggctactccttgggccaggcatggctgctatgtggatgtgcagtagcctagtaatctgggctatggttccgaatttcaagttcctccatgccctgattatcggcgcatgcgtgaccccaaccgatcccgttttgtccaactccattgtcaagggaaagtttgctgataaacatgttccccgtgagttgcagagaattattatcgctgaatctggcgctaatgatggccttggctatccattccttttctttgggatctatctcctccagtacacggggatggcaagccagagctatagcggtggcgctgggaaggcgatggcattgtgggtctacgagacctgggtatacacgattctgttaagtatgatctacggagctctggttggttggattgcgaggaagttgttgcactgggcagaggagaagcgctatgttgaccgggagagctttttggtgtttgccattgctcttgcagtgagtttacctcaacccccacccccccaaaacaaaaaaagtgatttgctgatctcccaaatagctgttcattgtgggaacctgtggcttggttgggacagatgatcttcttgcctgtttcattgctggaaacgtattcacgcaagagtaggtcacctcgacatgggttataatatctcgaatgctaacagagacagtgactggttccgccttgaaaccatggacgattccctccaaccgacaatcgatatgcttcttaacctgtccgttttcatgtggtttggagcggtctgtccctggtcatccttcctgaacaacagcgtgattccaatctatcggctcatcttcctgggagtattgatcctcctagtccgccgcctcccgatcgtcttcgccatgcacaagtggatcccgcaaatcgatcacgtcgctcaggctgcattcgtcggcttctttggtcccatcggggtgggcgctatcttctacctgtcagtcagccttgaattcctgcgcaagatccaagtcgagggcgaagtcccagaggatgtaaagcaagtcatggagaccattcaggttgtggtctggttcctagtaatctgcagtattgtgagttctccccgatcaaatcccacatcctcctactttactcatcttctaaccaaatccaggttgtgcatggcctctcagtccccgttgggaaagccggctataacctcccagcaaccatctccaacgtcatcagcatcagcaccagcacatacgaggaacgcgaaccggtccccatctcaaacaccagtcacacacacagcacggcaacacctcccacaacggcacctctcacaacgggggaggatgcgagttaccgcagccgcaagcgtggtttccggagcgcaatcccgcgcccgcccttctttggcattggtggctcggtgatccctcctcgttcgccgtcccaccagcccggcgtgggtcagcccgatgagccggagagacatgttcagctggttattcatcagactacgagcggggatagcaagcctcagccctagttttgcatctggaaattcgactgatccaggcggctatacttttactttgattggatatatatccaattgcttgatcatccggtaggggaagcgaagtgttgcgtatcattatacctcctgcttttgcccagaattttagacagcatgcataagcatattgttttccgtggtccatttcaacagcattatcgggggttttcctgtggggttgcatatttaaccgtctcaatatgtacagctttgtgtatatgatgatttatccaaatgtgtacatagtcaatacataatcccattggtagaacgtcatcaaattcatagtgtataagtagtacataagtggtttcatcaagtttggtaaggcctaataccaagtgatatcgtcacaagaactcagattggacagtatgaataaagtaactgcacttgaagtgataataacgccatgccataaatatggaaactcgagagtgcaggaactagatagatacaagggagacgcaacgaagctttacacaggccttagatcacccacagcgccatgcatggaatgcccataccctcatagaagatctcagaagagtagcaaatacaagtggtgtgcattggtatcaaatgtgcccaggacatcccgtttcccatgccctaactaaaggaaacttcataacctcgtcaaggtgtttgacctgatagccaaagataaccattccacccatcccgaagggtaccagatcatgttctctgatcgaattcatgtgttctttttttggatttgttactttccttgtcattccttcgatatcattacacgtcataccgaaaagcaaaatgataacgccgttgatgggtctgagagatcgtgaactcatcttgattctgaattcatgattgcaaaaggcgagagataaaacgcgatttaagacaggctggtgtgcagatcgcgggcacggcgagcgaggggtgaaataagtcgcaggattgggtcgtgcgggttgcgctcaacgactgacatatacagggtattgaggcgctggctcatgatgtccagaatgcgaggtgcgacttcatggagatcggtgtcctaaaaagccagagttagtcaagatgatacgaatatttgagatagaataatgacataccctggcgttcacgttttgaagaaccacctcgagccagtggaggcgctggccaatgttggtctgcatggtagtggtgacagcaacggccacggagagcatgacgatcgcagaaagtcgggacaagtaggccggagaaatgtggacaaagaagttgtcgaacaggtcagcttgctggttcgattggagccactaggaaatataaagttaataggaacattcgaatatatgggagtgattttagacaaaccttgatagtgccctgctcgtagtgaccagtattgataagctggacgatatcccccatttcgatttcctcaggggatcgcgcgataggggaagcgacaggaaccggggccggggcctgaaccgggatagcctgaggctgaagccgaggctgagataacggctgcgacatgcgcacctgattctcacttggctgtctagtcgaagagcgcttgttgacgttcaagatctcacggtgggggatctcgtgctgcgggctttggctctgctgaatttggtggccctggttcgcggccaacaaagaaacggttttggacaagccacgcagggcggccgacatctcctcgatctttgcggtatcactctggcgctgggtttcgtagtggttgatctgggccttgaaatggcgttccatatccgactccaccttctttgtggtacgtgccaagctctcaagcatgggggcaatcgaagactgcatgacccgggtaacttctgtctcgatgcgaggtgcaagcttctgtgcaaccgaatcggagacagccttcaccacagggggctgctgcatagcattgatgacagccttgggaagaacctgccgcaactcctcattgaacgcgcctccaagctgttgagagacggcgccattaagctgcttgttgactgctgcagaggtggcatcggcgatgacaggaataacatcggcctggatactggcagaaacaatacgcgctaagttcttctcgacgttgtcggagagcgtgctagagacaaggcgcaacacttggtcttgcttggctgacgaggcagcatcccagctgcgacgttcatcgtcgaagcgacgatggaggttctcgaactcatggccaagactcttgttgaattcgcttgaaacactaccctgcagggtctgaatgtgtttgctgaaagcttcgttcgagaaaccgaaaccaggcacggcttgttcggcggcctgagtcgcacccatcgccgtagtagaagaggcaagagtctcgaactctttggcaggggcggaggggaccggcagagattcgacaccggtagtaacggatggctcctttgtcttggcagcttcggcggcagcggcagccttcttcttcttcttcttttcagacttctcaaccacgacaggtgccgctgctggttcagtgggctcttccttcttcttggccaacttggtaggcgaagcgttacgcgaaggagcaacgccagaagccaattctccaatctctggctttttcaccgattccttgggaccaacgcgagactggatagaggcggtgtcaccgttcacagacggatcgtcggtggcgtatgtggggaaagtttggagatcgctgatttcaatcaagccgtgctccaatgcatcgatagggcgaataaccttgttatccgcagtccagcccaaatcctccttcttgatgttcaagcaggtcacaccgcgcgagtgcataacgtagagctcaaacaggggactttcctcagtgccgcgcttgtcagtagcggacttggtgatagggagaagctccaagcttctcaactgacccttggaaccgagagagatctcccgaattccactcaagcaagcagtagactcgggcttgggtagggtgttgtccttatcgttgaggtctcggatgtaggctgcctgtgacatctgaggcagattgtaccgaggagccgagaggtgagcaaagtagatagagttacgtgtgggatgtccaacgacaatgacccctgatgatgggtgataagccacgctgcagatggcatcggactcgttctcgtgcgggaacttcaactcctgcacggccttgcccagcccaatatcccagagctgcaaggtgtggttttgcttgagaccaaccaaaacataacggagcgccatagatcgcgaataagcgcgaagcttatcgaggaacagcaccgaagtgggccaagacttttcggtgggggagcccgtgacaaatgtagtcaagggcacccggatctccgcaggagcagggccttccacaaagctcgcgtcgttaagcatatcatgtatatcccagaagcgcagtcggccagtcttgtccaaagaggcgatgacagagtcatcatcactgaaagcgaagtctttgccggctttaccagtggagatcttcaacgcacgctccttgaagaatttctcagtgttaactgtacgctgagcaccagaaacgccgtaggtagggctcattgctgccttcggcgaaacaacgtagatgttcttgccccgaccaatggcaaacaagttggtgtgacgagtgctccgcttggcccgcgttttcagctggccaccagaggtgttctcgtctgaggccgggaaaggtgggaagatcaagctttcactttccaaggcatccatatcaaagaaatcctttccagaacgcgagatcaaggcccagtatacagagccgctgactccaatgccgaggatggcctggacctctgagtcaccagccgcagtaggagctgtgcacaaggcaacgttgaacactcgatcacgggtggaacggaacacctgtcggtcactaccgtcatcctgtcgaataattctgatgccaccagttttggcgagcgcgtacacaatgtattcggatgtagccgcagtcaacgagcggtcaagctgatcgaactccttcttcagacgagcaatatccatgacatcgtcatcccggaaggtcgtgagttttccagacgtagctttaacagcaatggagataaagggtctcattgggaagttgtgaacagagacaactcgttcttcttccttttcagcactgtcttccgcactctcccagctgtcagctagagcctcggtgttctcagtcgccttgggggcaaccggaaccgcggcaggttctgtctttgcgagctcgtcaacctgggtcaagcctgccgcttctttagattcagcagcagtctcgcgcatatgactagcggtcgatgaaatgactgcttcagagggttcctcctgggcagtagaaacagcagccttggcttctgttgcagcttcagcttgaggctcatcgccactgagagagcggccaatctcatctacgagacgaccaacgacctcatgcacagcttctctctgaccttcactcaaaattggcgactgggttctctccttgggggccgcaagttcaggtgtctgggaaggctccagcttagcagaaacattgattttttgcttctgcatgacttcaacagctggactctggatgccagaggtagactggggagacttgttaacaggagaaatagcggccaattggtcaaacggattgacataggtgaacattgagtccttcgagttgggcgatacgaccgtttccgggttcgcaggcgccttgggattctcatccacaacttccataaagacattcttggctgcctggttctgatgttcatcaatggcagcctgcatatatggtgcctgctgggttgaagtcagcgccggtgattcggcgacagcaggttctggctgagaacggttgagcaggcgaagtaacatatcctgtgtgttctcattagggccctcaggctgaccagactggaatgccgggggaggggcagcgggcgcagccgtaggggcctgctgaccgaacaaagtagcaactaggtcagacgcggaaatatttcgtccgtgtgacgcaggagctccctgaaccggcggggactgcaggtgctcggaaggtgcagctggggcctgcggctggggggaagcaccaggacgctggctgaatctgagaagattcaaaaggtccacagagcctgggttggcgtgctgtggttgcggctgctggggccattcgccccgaggagacggcacgttaggactcaagacatcagagccctgatgagggggaacatccactggggcaggactttgggtggtcgaggtcaccgatggatgttggtagccatgcgactgggggtgggggtagctctggccatcgtaaggttgctgctgagggtgcggcgggaacagaccgggctggtagtacgattggcgctgggcctgaggattatcctggccaggagtgtttgaaggagaagggcggggccggatactggctaagagagcctggagatcggtgggggtggacatttctgccgttacgccgtggttacaggcgacctccgccgataggatccaagctttgcagagctctcagaagctctctttcgagagggccagagtatgaaactgggaatcagaaaggctagaaaggcaacaaaagaataaatgaaaggtaagtacgagaaaagagagatgaaattgaagaacgtggtgaagtagagaggaagggtgaaggagagaagaactctctgttcaagccgtgggtgtggctgagcctgccgagttgtggcggactgtggctagtgttatttcttgcccgattcgcgtcattaatgtatcggattactttacttcttctagcccactttcactttactgagttcgaaggtggtgagctcactgggatagttcatcaggaaattccaatatatcaattacgtcaaacgacgcttttgtccacctatctgcacctttccgccatcaggccagcgcccgcaaaacctcatcatgttctgtctacgaaggtaagagaagcaaccaacagcaacaagcagcaaagcagatgattagactaacccaaataaactatactgcagctggctacctctccttttcattccgaccaacgcctccccgctcttcatcatttcgtttgttgccttgacatacatcatccaccggccatgtatttactgctccgcattgctcctgattctcttcgtctcgtcatgtcattggtcagaccgatgcatcttcgacctacggagtaattggtttgcaccacgctatacctcagaacctggcgattatgctctctcgggcaacgcaacatccgaagcgacagtgcctggcgatggcctgacgggatttgttttcgatgctatgaactccaccgccaaagccttggctggtgctgcgttggagggcgtccagcaacgactttctcccagtggaatggagtcaaggcccaacgagtggacaggagttgggttggagtggatgcgcagcctcttggggagacgggagtggactcttccatgtgtcgatgtcaaagttcgactatgaagttgcaaaaaagttttgattgaacatggttttcttgttgatatattcaaacgaacctttgatttcacatactttatttacgatccttgtgttttcagttcatgtgcaggtctcgataccctcccttgaaagctcatgaataaccattgtacataacccattctatactaatttatcgatcattgaatgacctagcgttaaagatatagattcttctgctgttgtaactcaaccattgtgatgactacatacgacatcatgcgagggaagacgttgtctagccttggtctagccctcacctatacgtccctcatactaatataagtattgccgccgacaaagacgaaaagagcagaaatacagctagaattcctacgggaacgggactgactgctatgtatgcactaactatgacatgcaatgacaagatccccaactagcaagcagctgggggccacatggcgttcaccaagaaggaggcttatcgtcgccatcatttgaacccggacagaaaccgagttcaaccagcatatcttcaattgctggaacacaagcaacacatgagcagatctagactcgggtcttagtttctgtccccaaagcaaactcgacgaaggcagaaggatatacctgggtcacggaagtcgtcaaacatttctgcagagcagcgggatcgccattgtttatagcattagcaatgcacctaagttcggccgacaagttgagacaagcagcgagactacacgcctctgggaggtgccgaacgatatctagattatgttgccgcactgtacgtatactttgtattagcatgctagcttgccccaattacatgcgaggagttgagcttatggaaagaggtctgtacaggtggtctggacatgggtattattagccaccgcagctgtgcctgcagctgaggccaaccccgaggcgaggacaagagtggtcatattgaaacgcatattcaagaacctttgcagaggattggaaacaagtaaccaagagggataagtttgaatttggtacctattgtgttataaatggacgagcttacgctgttgaattaaatagctgcttataatattatatacaccgaagtttaggagtcattcgcagcaaaagacaacgacagtcatctctcggcttgaatgtcacattggtggccaagtgatagatgggcatatagagcgatgtgtaaaccagaatgcccaggggtcacactgagtcgcattagaaggcttgtctttccccaatgtccgtgtcggggtagataggtagcatcagagactgcctaccctaagagactagaggtgtgtttccacaaaagccttcccatgaatgatttggtctcgtgattgggaatcggcagttttagtcatggttaatgaaatcgggaaagggcgaggtagctaaagtcgattatttgacatggttacaactaagtacatggtgagaggcatctgtcattaaataaaataacggataaaggccgacgagaaggtggtcgaccggaggactgggagctggaaaactctaagaaattcataaaacgtagatgggctggaacgattcacaaagcaaggcatgataaccaccgtaaaggtaagagatggcagatgaatcgtgaaacatgacttaaggaaatggggtatcacaatgtcgacaatcccagttcaagatcaagattcgtaaacaagcgtgaagaaagttatgtatcgccggagaataattagagacgttgaaattcgcacgcaagaaaccgacgaagcaaagtcatagatgttgcaaatggcatgattatcaaatcagttgtagccaccaccacccacgggcagaggccagtcgtcttcagtgatactactccagaaggcccagaccccggagacagaaaggagggtgaagagggtttcgaataaagctccattgatcttgccgtccgaggcctggcacaagtgggtgctgatcacatagttgaagacctggccaattgcgaacaacaagccagcaccggtgagatacactgttgcaccgttagcacatgtctgttttgagcccagtgtgatgtacttacgcattggccggaactcgcctaggacccggagcactagtacggcttccaggaggtagaacaagacaacgcagatgagtgggaagagttggtacagaacatagagggcgatgttgcgatttggtgcgtcatagcttgactggaagcggccagtccaatcgaatccagtgtccaatgcaatatagcctgtcccgatgaagagggccacagcagatgcgctgatgagaccgatggaagctgcagtgccgtcatcaagcaactggaagccgacgagtgcgttcatgaggaggacccagcaagtagccgtgatcgcggcaatgtgtactgcagaaaacccctagatggttttgtcagccgaggccttgagtctatctatcctgtagaaatcctacctttcggactgcgtcgctgagcgggaagccgcctactgtgaagatctcgcagacctcaacaatgatgaaaccgagcaaaaacaattgcatttccctgcgcacaccgccatgtcagctgatattcctatagagaacaatatatcccatacctccggccgaccgcagcgtgtttcttatccgatctccatatcatacccacggtcaagataatggcgatgaaggccagtagaatcgagcctatcagaaattagcaacgatcctcgcattatttggtcccaatggcatcagcctcgtgcctcatatatcgtacctaagttccgaaggtgcctatccccactgagaggaatgccggtcagatcgcacgcgccgaaggcatcagtcgcggtttgattggtgaaaagctgtaacccacaaatgatacagtcagttaagaattccaagccattataagggggtttcaagaagatctcactcacattgcagactggtagggttgagtcgcgacagaagtcctgtggtacccatacgggtttgcggtcagtatctgcttggaggttcagtctccaggtacgatctgcacttacgtgaaagttcccgaattgagtggaccccattgcgaattggaatcttcaaacgagagatggataagtatgtgaggcaatgttgagaagagactgttgagacttgagagttcaagatggggggcgtcttgacccgcgcgcaggatcgatccagatcggtggatctctagtgaaaccaggttcaggttgaagttgaagcagaagcagaagtagaggtagaagtagtagagtgaaactatgtaactgtgtagctgtgtagctgtgcagtgtagagcgtactgcgaggggaaataagaaagctgattcccacgggttactcgggggactcacagggctggcgctagtgtggcttagaaaacaaaaagacctgaacttccaagttttcaggtcgaacttcgatccaaatcaattcaaatcgattcaaatcgacttaaatcgaccaaaatctgaaatccgatcaaaacagattgaaaagagtggcaatggtggttccttgggtccagtcactaataatagtactctcttccgattaggtatcaagtataaaattgctgtgtgtagagaacgcaggctcttgtgatattatagacacttgcaggtctccctagatctgggatatttgttatatttgttatatttgttattcttttcctttttcttctttttgataaagtggtttacctcaacccttgccgaagaacatatggtcgccaggtcgaccagatggactcaggccacaattagcaaacacatacaattttctgaattttgctttgatagagtactgggccattgggatatatttatacgatcatgttatgtgcctgcgttgtaccgttactctgtacctctacggagtatttcgcatggtacttacatatgtatatgtagaagtataccccttaagaactcgatttagtcccattggaaattgattgatccacgtccaattttaacgaatcaggcccttcttctgtaggggacctcatgtagtctcacaagtattcaaacgctcctcttagcacacatcttcgatcaccaatttttgcccatcataatcgcccagatccagcttcaaggtgcgcccaaacagctcaagcagcatctcaaagcagaccttgctaatagccggatcataccgacccttgctgagctcatcacggataaaggcatctgaatacgtatttctgtcagcacacttgtgtttaacagtgttgagagtggtgttcaactcacgttgtgcccaagcgacttcatagaaaccaaataaaacgcccttatcatgcaaggtcttgcggatgagatcgcgtccctcgggcgggacgtggttatcgtttttgccgaagatctagagattgtatttagcaattaaacccaaacgaaaaacaacagaaaagaaagatcttaacataccattagcatctcacccttgatatccccagctctctccaaactatcatcgttctttcccagggcaagggtcttgctgtggatatccgtggcaaagtaacacacgctcgccttgacccggctatccagcgcgcaacgataggctaagtggccaccaagacacatgcccgtggcaccgacttggccattgcaagtaggcagtgagagcagataatccacactgagactagcgtcttcatcataagcggcaagtttctgatatacagtcagcactaaaattcaagcccaaaaataaataaaaataaaaataaaaagatccctaataaagaacaagaatggaaaacgcaagtaaagcatgttactcatggaagctgtgttattttgcttaccttaccaatcttccacgcgttccccttgtccgtgtcctcggcgtcatacttcagaggttccgggccagtgaattcatgatagctcgaaggagcagcacagatgtagccctggcctgcgatctggcgtgcaaagcgtgccacgggtcccgttactgcgggtctttagtggaggtgttcgggcatgatcgcaatggggggacacgaaccttgatagatctcgctgaaaactacgactccggggaagcgggctttggggtagcccgggattgtcgggtggaagacatagatgcctggtaaattgtcaggattgacactatgaaggagcaatggctctatagaggagagaaatgtgctgtagagggaccgtagtgtacatacgcatcgttccctgtccatccgctttggtggagacatcatgataggattcttggatcagcatggtgtctttattttcttttcaaagatagtaatatactggaaataagatcgaggaacggattggaatgatcttaaagaatacagatgattgaggcacgaaagcattatcgataacacacacgcggggcagtcatgtgctgatactggccaacatttcaactacttagatccatctaccttcgatacattgtaggttaaaactgaatagaaaataatgtctcaaatatagatgaacttcagaatctaggtgactcggcgcaaccgtacaaaagtcataaaaagtcataaagtggtttccaaataagtcagaggccacaccagagggtgagatcttgcttcatgatcggtgcaggtattaataacattccaattcgacgttataagggtttgtttttatacatatgttacatcaaggttgtttggcagaatgatggtcgagttagacctaaagaagaaagatcccctgggctcccacctaccgagcccccaatgagtccaagggaaagcagcaggctgcgattagaagacatactatgatttacgaggtcagccacaggcgctgggaaagtctttaataaggtcaagttactcacaggaatgaacaggtaaggcacctggcgttcgtactcgagccaggtctcgccgtacttagtgcgacaccgctgaatatcacgaagagcacggtggctgatcatgcaagcgaagaaaacgggatagaaccaagggaacgggcttgagaagccggtaatcaaaccccaattcagagcgaagtaaagatcgcacgtgtagtggattttgcgggccttgccgtctatgaggtcgttagtattggaatttgtagattttgatatttggcatagacttacaccacccatctacaagaatctttgaaccatcagccgcagtaagggtcttagggttctccaatgtctgccagggaagttgggggaaggtgttgcgggacaccatggtaccacgctcctgctggcggaaacggtttttctggctgttggtggtatcccaaacccagtagacgaacaggtaggcggcaaagaggaaggcaaggaagtagcggttccagcgatattcagcagggtcgtggttggcgaggtaaatggtgcagtggcagtagctcagaggcacaccggccaagttccagaagatcagcatgaagccccacttctcatagtacatatccctgcaaaacgttaggaaataatcttgattctggagcaggaaacacccttaccaggtagacacaatgcactcctcacccttggagcaggcattggcataaaggtaatgagccatgacaaggaacataacctcgccagacacgtaaccatacaactcccattggcgggcagcggcgcccatagacaggccgagcagaatgtaccagggcaggcggacctcgaagaacatcttgaagtcgaggatcttgaacatgcgggggttaagctcggcacccatgaagaagtcatagatcgggtagccagtcatacggtgctctgcgccacgcgccaaagccgagaagtaggcaatgaaagagacgatatatccagaaaggatggcaacgctgagcaaggggccaaactcatcaatgatggtgtacagcttgaagaccccagtgacatgcgcaatgagtgccaatgcaatgctggtatagaaagaccacacaccagagcagtaatatggcagctgcttaccacccatgtgtggcagggggcgacccgaaacgctcacaccgggaagaagcacgtaacatgcaccctcgaagacgaagaaaacccagtagatagtccatgccttaactgacgggaaagcaccggtgtagaccagatcgaccaagtgtgcgaaaaagtcgccgtaactctcgttctccgcggggcgagggaacttgccatcgtagtaggtggcaccaatccacatgtagtacatgagcatggggaatccgatcatcatggatagcacacccaaggagccaccgaattcaaagtgtccgctatagtccaccttgggatcgaggccttcctcccaaccgtccaccacgcgcgatgcggacttgggcttgggggtggtagtattgccattggtcgtgaccttcgcaggtgtatcatcctcttcaatcttgactttggctgaagtacgacgacgggaggcggactttgatctctctagggagggggagttggagacctcactctcgctaccctcgaagacagaattgttgcgagtggcacgacggccgccgggagtctcaatgaagcccgggcgatccatttttctggaggaagaaaggtttccaaattagcttgacaaaaaaaaaaaaaaaagcctagtatatgcaagccaaaagttccgggtattggcaagatataaccctggaggattcagggtgtggatacgtcgcaactaagatccggtgggaactactcacttaggggtcttccccgtttgagaacgggttaaagtcatggtcgctcaatcggaagaccaaggttccgactgcaattgagggtaaggagaggagtgactgagggtaaaaaggagcgagggtggaaaaaaacaggaatgccctgaatgtttactttgtccgccggccccgtactaatggattacataataaacaattttaaaatcagcctataaccttaaagacttccaagtcaggcaaaataactaactatcggttatgctgaagttcataatgggggtatttatgtatttatgtcgtttgatagttagtactagagtagtaaaaggcattggtaggtacatagtatattcaaaactagaagaacattgaaattgaggtatatagatttccctccattcgacactaaaagggggtaaatctttctttctttttttttttttctttttcactataacatagttacatagcaccccgtggactagcagataggactgtaatattttaccccccactattccgtacaactgttgtagttaaaggcaatttaccatttagggagaattagtggttgagagtgtcattgtggggggctcgctgtcaactgcctattttgactatttggttcttcaagccctagatctatgcaattaccccttattgtatgccaatgtactccgtagagggtatactgtatgtctggactggttttatttcttctaattcttctcccttttgactccttactcttaactaccattgagggagaacctttttaacagccttttccccccctatactccgtagaagacattgtaaaagaatcttaaatataacgttccatatatcatcttgagtcaaatgcatctgaattgtaaatgtaaatgtaaatgtttatttgttttatttaaatatttcacaaaatccaacagtaccggtaggatagcacacgggcacagccgagaaccacaaataataagacaacagcccgaagaatcagggaaatggtttcatatatgacaatgcagtgcggttcaacataaaattgagagaagtgaaacaaaggcttcgtcaatacctatgcccctctctgactgctagtggccatcaaggtgatcttagttttattcttcttctttttcttacctgcactggaagatggtccaggatttgcattttggtctccagatgccgtctgagcaagtagatcagattcctgctgggcgaagagctcatcttcccagccctgccgccacccgtcactgtgtatagctccttgagcctcaaggcttggtgacagtgaacccactgccgctgtgccccaaacagtgcggctacccgggggactggtggaaggagaagccaacgctccaaatccagccgatgagcgtggaggagaggccgaggaggcggtggcgtcgtataatgtgggatccgcgttgtgaggcagtggttggaagtcatgagcagagaatggagcttcactgacgctggcacttccgatgcttggccgcttgcgccgagcagcagcccaccgtttgtcgtcctcctccttctccgcgcgaatgcgatctttttcttcccgggcttctttttcccggttacgctttcggcgtctatcagtctctgcgcggaaacgcgctagaacttcggggacaaccacgtctctccaatcgcactccaggaagctaacctcacacccctgcggaagatgcccgaggtacttcactcgcttgcgaagttcatcatccacaatgtggcctgttgatatatgctccactcgcggtaggatggttgcagggaacagagaatactctccaaacgcagccttgaggatgcgaatgtccaaggaagagaggtagaattgaggcaacgcctgatagaaatggtatggttgatctggcccggaagacactggcgtttgcttgctgcggcctttctctttagctttgacactggatccaggttcaaggtggactccgtctagggagttagagagatgatccgcttcatctgatgtagccggcgtcacggtagtgtgctcagaagagctactggatggcgtaggagctatagtgcgttccttaactggccgtacctcaggtggattgccaatgcctttcagcttctctttggcatccatgatagaaccaattgcttttcgggtccacgtattctcatcgccaaagagaagctcgtcttcaacttcctgtttgcggaggtcttcaatctcggcatcatgctgagcggtcatatattcttcgccacctttcatgatacgtgcatagtcggcaacttccgccacatcataccacggaacatcctcgtctggaccaagtgtctcagatccatcacgaggcagagcaagggtgctgcccggctctcgctttacgagtctcaatacaacatcaccgccttcgacgggaagatcgccttcttggccgcggaaccatctgacaggtcgagtctcggagatatacacagaatcccagcagataggacatttcttccagcggtgccgtttttcagggaccgtgttatcgtcgtcggatgagtgcatgtatcggataagacatgggagacaaaatatgtgaccacaccgagccattcgcggtgctaccggagtagaaagacaaatgggacaactggcagcctgcgtttgagcagataccagcacttgaaggaccgaggcccaatccagatgaacatcggcattggctgcctgagcatggaaactctgattaggcatcacaataaaccggtaattcgcatgaacataacgtgatttgtcgactgcacccgctccccaggatgtataccgtcgaatgctgcggggaggtggatggtattgtgggcgaggtggaagtgaaaagttcattaagtgagtgatggacgtctgccctttccggctggtagtggatttcatggcagcctagataacggctctagggtcagcaggcagctcttcaggaagatagacccgtgaacccaccgattcgttatactcgtcatcatccaataaccgaggttttctttgacggttatgttgactcttccgagcttgattattccttggggtggccgaagttttcgatgacaccactggccggaagcttgcagagcctcctgcgcgcctttgagagctgttttctgctggagctgctgagtggaatggagtagacgaggctgtattcggaatgtttaccgctttagaagggggcgggttctgtcctgcattggatgacatctccctgcggtatttgcctgcgaccgcgagaccccaataaaccaaacaagaataaaccaaacaaggcagagagacagaacaagccagttggctgaaaggaggaggaggggttctatgagggactggataaaaccactaactgataagatgtcaatcagctagcgggcagtagatcgagtgatccaccaggtgcctcggcttggaccagaagaggtgaagaagaatgaacgacccttaaggccatgtaagaatagtaacgaggatcgagggacggccctcagggtaccagttgatgtcgtgaagatgcaatttcgcccctctccggttacaaatcgtaaagtcacgtgaaccaacaagtcccgacacccaattcggtctcggtccccttcagcttcatttcgttcgacggtgaatcgaggcctcctaaccctcgtctcatattcttttttttttccgtttctttcattctgctcactcgctttatccccgaacttgtcaactctctccgcctagggagttacttgtacagcgatttacttctttctcttgtttcctcactccgatctggtttgccagtctccttcaaccaatcccagcagccaaccccaacagctctttcgacccagttcatcctccactcccactctccaacacatccagcacctcttgcccgaggccacgatggctgcctaaatgcgccagcagctccagatttttccttcctcttgactgctatcacgcatggcactcatttgaggcaacgcgtgaccgaacgtcaagacaacttctttctctaactagctcaagatgaaccaccatcttcctgccatgccccatgggcagctgcccatgcctcctacaaggcgccagcaggacttctcttacaacgccgcgcctccccacatgcgatcacctcagtacatgggttaccctcacatgaatggccacatgcctcatcaacaatactcatcgcagcaatacccttactggtatcccccatatggacatgtccaaggccctccacgtccctaccaggcgccctacggaccgatgattgtatcctcttaccctcactcgcagcctatcatggcgcccacgcatattcctcattcgatgcccatgcatcaaagaactccgactccactgcaacccataatgtctccatctgtcctgcatccatcgattcaacccattcagcccgaaatccaggaataccctgctgttctaccgcactcagcccagggatatcccagcgcttcaccgccaccgcgatggggaccacagtcaaacttgccgccgaagcccacttttgccccaccagtaagtgtttactctcaatatcaaattagacttgagcacttttctaactcttagtctagattccttggctctctgttcctgagcagccgttcccggccagggtcccgcgcagacgtcgcaagggccgtgtcatgcaatcatcagttgagcttcccactaaagacacgcctatggccaccgagcgaggtgaaaatgaagcgactcagccatcttcttcatccgcccgagaatcttcggaacctcacaccccaacgaccaccaccttccaacagtcagatgcagactctacacagcccaccactccttcgtcaattgcgagatcacaggcacagtcgaaaggctcaaagcctgctcctgttattccagtggtgcccaacgtaccatctaccccacatcgccaagccaaagatggcagcgtcgcatctgggactcctaagtcgactgaacctgctacccctgccccagtggtagaatcggataaagccccttccactgaaaccaagacaatctcgcctgccccagctgcacccaagtcctgggctgatttggtccgttcgaaggagtcagcaagagcagtaagcgccgccgccgccgccgctttgtctgagccacacgggctacctgcccagaaaaacaaatctctcgcagatgttctgagcaaattgggagaagatgtcacacaatacagcgacaagatcgcgtttcttgaacctcggggactggtcaatacaggaaacatgtgctacatgaactctgtgttgcaaattcttgtttcttgtaccccgttctaccagttccttgatcatcttggccgacgtgctgcgcataccttccacagtgaccttcctttgatcgacgcgatgatcatgtttatgaaagaattccgtgttattgatgcggccacttccgaagagcaacttcgtctcaggttgaaacccaatgagcttgagcaatatggtgactctttcgttcctgagtttgtctatgagatggttcgacagctgccacgattcagggacatgcggcgcggacatcagcaggatgctcaagagttcttaggcttccttctcgaggaaatgcacgaggagtgcgctcgtgccgaaacgcacactgcaacaaaagaaggcggcgattcttctgccgatggctggttggaagttggccacaagcaaaaagcagcggtcacccaactgtctggctctcttgctgccgagtcgccggtcaccagaatctttggggggaagcttcggtcagaattcaaggtgcctggtaacaagacttctgttacattggaaccctatcaacctttgcaactcgacattgggtcgcatgacgttcacaacattcttgatgcgcttaaaggaatgacgaagccggaaagcatccaaggtgatttcaactcgtcgcgcggacccaacattaccgcgactaaacaaattttcattgagaccttgccccctgttctcattcttcatctcaagcgcttccaatacgacagtgttacaggtgccactcagaagatttggaagaaggttggatatcccctagacctggagcttccgcgggaggtcttcccagctcatcggcgtaacgccatggcatcccagggagggcccccgaagtatcgtcttatgggtgtcatctaccaccacggaaagaacgctagcggtggtcactacactgtcgatgttcgccggcaggaagggttggaatggatccgcatggacgatactgttatccgtcgcgttcgcagcgaggaggtggcagaagctggtggggaggaagaccctaaggttctcgctgccgctcttgagcagcacaagcacggcaaagtcccgaacggcaatattttcgaccacatcgatcaggatgatatggacttggctgacagcgacaagggctggagccaggtcaatggcaatggtaccaacggacatgcgagcaagaaatccgtgaatggagtcaccccacctcccgcggctgcctctggggcccgaactcccctgggtcgctatggctctcgtgacaacaaagttgcctatctattgttctaccaacgaatggattgagggttctcgcccaaaagctaggccattaggctggacatccattcttcaacgacgtattgaaaaaaagcatcatacccactacatcctgcgatacatcaagttctgtgtcttccacaaagtcatgcagtttgatcctcgcttcggaggacgacctgccgcctgtatcaacaggccatacataacatcaatcaatcttggcgagctcgttccattttttgtttacagctctcgcctttgcacatgaaacaccgttcacaacggagccatctggagagaggaagacaatctagggtacggcggtcccttgatgcctactacctctcacctaaatgctccttcatcatatctcacttttgctccacaaaagcatctactcaagactctgtcttgacccctttttctcttgctcgttttcagtgtgatgaacccgaatcatttgctacacaacccattgtcttttgagccaattgcttttttttccccgtctacctctgggctgtatcttatgggatattgacctcggtttatacccctctccgttttcacatggatacattcttcaaagccatcttggccctatcgcacactaccaggccaaaaaaagagtgagcctccgtgaactgttcctaccaaattctttatgtacttttgccatgtcattcgacatctggcgtggatacaggagatcctgtgacgaagtcacgaatttccttgtcttgatattgattgctctgtctgcatagaagggtgttgaagagggccggggttgttccggggcgtcgggggcgttgctgttgggggagaagggaggttaatgccagaagtgtggaggtttggagaagtgtggtgaatgcgagaacgcagaataccaggtgtggtatgtcaaaaagcctgtttttacccaaaaaaaaaaatttcaaaggaagtttcaagttatctccagtgtgtagtacagtacatatgtaagtaggtcccgtaactgatattatgtatactcatggatactatatacatccatatactaagaggatagaagatatctttttatatggttcgttatctagttctcgccgatagaaataacaagggtagttccgcgcttttcgagtaaaaaattcgctatttcttatgcgatagaaggctaggcctctatatcgatctatagagagaatctatttttcaagaggttcctccttaacttatataccactaagccggtggcggagagttatacgcgggactctataggtgcgagtagcgagagtaatagatatgatacctccctttttaaacgcctagtagctaataaaagcctaccctcttacttggttgaatctttcgaggattaagagcgaattggtggcatagtggcttgtgaatacgttagttatgactatatatgactataattatatatgccctaataacgtaatcggtaagcgagctgcgcacgcaagcgagctgcgcagcccaaaacacatagtaaacgtgatactctatttcaaccactaacgcttttattcaattctactatttgccgatagcaaccgataagcattcttagtactatatatcaattttgagtaaatcgagaacttgcattgttatggtaacgaaaaatacattgctgaactctaggatatctatagatatatatatatctcagtcaccaatttatcaaatttctcgaaactccctaaagcgacgtaatattatatataaaccaataaaccaaaaggaaatgttcctataaacaaccgttgttgagatatcaagttgtaatttatcgcttttactatgtgttttgggctgcgcagctcgcttgcgtgcgcagctcgcttaccgattacgttatgacaactttacttagttctgtattaagagctctgtatgatcaaaaggtaatttttcttacatttacttacctttcttacaaaatcaatacacattttcacctagagagccctgtaatccgtatgtaacttcgatacacctgacctcgggagacccctggagggcttcatgtttgtagaactacatacgttggatgtacatctatgtcaactggtgcctacatacatatacatatatgccatgaatcgggatagcctcttctttaacacagcaacgttggttgctggggtctttgtccttgactatggtgcagacaaattcattgatcacactgtgattgtaggacagcgattgggcatctctccaactcttattgcccttttgactgctggagctgaatatgaagaggtaaattggtttgagctccatcatttaactagtctatgctaacaagctccccttagctcgctgttgttgtcgctgcaatcctacaaggtcgcacccctttagccctgggcaatgttatgggatctacaatctccaacatcctgggtgccttttcgctggggctcttgtgttatccagacgggggtccttttgataatagcgcgaagatatactctgcactccaattcttcgtcaccaccattttcatcatcttggcatattttcaacagctgaatagagttaccggtgggcttctcatcgctctcttcgtactttatatcgtctctattggcattgccatctatagaggtatcagtgaaccacctcagctgtcggacagtgcaagtgacgacgaatcaaccaatgtttgtgatgaacaaatgccagcgcagagcgcaggacagccagcctcggagacttctcctctattaggagatacgaacgtgccccaggaactaatagatgcatccgtccacaaggacaaaagacctcggccgctttatcatcatgtcctccaactgatttttgggctgctagcactctccttgtcgggatatatccttgcccacagtgcaggcaccatcgccgactctctcaatctgtcgggcactgtgtttgggttaactgtgatcgctttcgtcacaaccttaccagagaagctggttgctatgttcagcggctttcgtgggcagggaggcatagttgttgcgaccacggcagggagtaatatcttcctgctaacactatgtgttggcgttgtggcggtggcggggaactctctcgatcagtcagatacatttgttctgtttgatctggtcacggtttgggtgtcctcgctgtcccttgtagcggttgtctttctgggaccccagcgaatcgctggccttgtacttctcgctgcctatgtgacttttctagtcatggagttcacagtttacaagcgttgaaccagggcattcggctttggtgcaagtatcgcgagcccaatctaacacgaaagcccaagtgcacatacacgcttgtatcttatcgtcccggacgtagtcttatttatgtatatagaatgtaggtcatacctgatataacatacagcgaacagatgaatatatgcaatcaagcatggaaaacaggcactttagcctggctctccacatccccatccccatcctccacaaactcaaatccaagagccctccagttcaactccttcctccaatgaagcccatagtaccctctttcgtcctgtctatccaccgcagaagcatcggcctctccagccggttcaagctcatcggccacagggccaacaaccggctcggaagacaggccaccagtccctaaccttccacgtctggggaagataacagaccggaaccgggagagaagcatgcccatagagcagcacagacagggctcatgggaaaggtagacgtccaagtctgtgcaaaggtagccgccctgcgagcgggtgcgaatgcgcgaggctgcgggagtggtagccggggtagaataatccgcaagtaacacggtagatgggggaggagcggggggaggtgggtggtggagctgggtttgagaagggtctgcagaggggtcgatcgtcaaggcggactcaggattagcgtcgtcgtgcttcctcttcaatgggaaggacggagactgaggtgggtttgagatgttggtggatgtaccaggacggtggcggtataagaagtatgattccaaggcgctcaggtctggctgttctagttttggcttcgatggatctgcagtaggcgttaatgcaggcacgccgtcgagacgatcgtgttctcggcgccagcgagcaacaagctcgacagcacgcatgagtgcgtgcagttcgggcccgccctcaatatccgcgttgtatgtcttgctcgctgggttcggcgctaccccggggtgcagctgggcctgggatgacgcgcctgcctcagagcgggagtaccgcgcatcaccggcaactgcgaggactgcttcatcccattctgttgtagtgtcgtatccggcctcataggctgcctcagttatctcttcttcgatggcagggtcgactatcactgcgccgacgccgcggcctagcccggattgttctgcttcctctgccactttgcgcgcgagggataaatagtatcctgcccgtggttcaatggattcctgtgcgcgttttaatgtttgagggggcggcgcgacagttgagcggggtgcggctgggttgaatacgaccggccagagggtgttggtccatgtttcggcttgagttgtattgaagggcggggcaagggggattttgatggggtgaagctgaatattagaggttgaagtatcggaatgtgaagcttcgtctggcgtttcattcgtagttgggggatcattcgtagcggccggcgctgggtcaggcgcaaacggagcgagcagagccttgagtgtggtgatatcaggcaatggtggtgatatgaggacgaagatggtttgtgctggggccgctagacggacactctggctttcaatggctgccctcagccgcggtgggagcatttctcttttggcgaagcgacggaggtgggatagtggaagggaagggtctttggggaaagccgtgtcgatagccctgaataaggattgattaatttagcttttctaacctgtaaagtatgccgggtctgtagcttacttgatcactttggatgcagacttcactttgacttctgcgacaaaggcatcacctacttgtcggttaatcatgatgtcgccaaaagaaggcaacattgtaggtcataccgaattcctcctggggtcttgtttcttgaactgttcgaatgggggcgacttgcccttcgaggggtttgaggcctctgatagtcttttccacgtccattcttactatctcaaatggccggccaggcgcggggtgaaacagaatatatcaagataggttaacaatatacgaccaatgtcattgccttgaagtggttgtaaaaggcagtggcttagaattgcgcacttgatcatcaattgctaacggcgcaataattcagcgacagaggaagtacatgtattcatatgaggacttgaagaaaagaagcagctatacaaaaggtaagaagcaaacaatgcaaacttctaagggttgtcccacgggtttgccgctaggccgctttgggtctttttgatctggagattttcacgtcgttcgaggggtttacaatgtaagaaccgatagatatctagtaccgacgaaggggtttacaatgtaagaaccgatagatatgtagtaccgacgtaaaacgcggaaggtttacaatttcaaaagattatgagtggatatttgagatttgtatggtctttttctttaaaaaaaaaaaaaaacagtttaagataataggtgatttgatcgtagatatcacctcatcatcccgtaagacatcaaacgccgcccagtgaaaagaatcgctgaaaagcaggaacagggtattgcccatttggcctcttggtatgtgctgagacagatcccatgttctaaagcgccatgtctgatgccagtgctcctcgatattagatcaaaagtaatggtgcatcgagatctgacaccatcactcccctaatgcaagtggtatgtattaaatcacaccgccagtgactcggcgggtgacagaagaatccactcatccatggctgactcgagaccggcccgagtgatccagggcagaacgtaatttgtgcagatttcgcatcggcgacgtaattggggcatggttccagctttatgttgaaacaggaccggctgctggagcaatacccgttaccccggctttagcactgccattctggcagatgccttcaatttcaaacccgtcgcatcgatcgacaaggctctgataataatccaccaacacttccggttgtggaacaatgcgccattcaactcggaacaagaaatctagttcgagcatggccaattccgtcatgccgattccaccgactcgagcatacgttttattggtccagaaactgtcactgagtcccttgctggcgactgtggcactggtgatcaggaaccgatggatggtcagactggaaacggtgaaggcggggtacagcgcgcagagtcgatcgatgtagtagaccatgctgaggaggatagggggggagagagtagcatgggtcgtcaaccgctgtagataatcttgcacggagattcggggcggtgagcgcgagtggaagcgagttagacgaccctggtgtagtggaatcttgtcgttgaatcggatcagctccatgagcatgctggagatcagcacgaccatgtcacgcgggtcggccagttcatattgcgtgggcaacatcttgacatctggtttggaaggtcgcagacgcttggactgcgacctctccaaatctgcgccatcatattcggccggcgtcgcatctgattgatggctattgcgcttgttggaacccgaggtaggggcgggcatcgagggggcgggggaggagatcgggggtggatttgtagaggtggcagtcgccggggtggtggcagtcagagcggaagaagtggctgattggggggtcgaagccaaggccgaattattgaccagggtcttcaaagtgtcggatgtggatgcgcgcctgcattgaagatcccctgaagtctcaggagaggagggatcgacagtatgtcgattcaaggccgagcgaagttcgtcaatggccagacgcgaagatcgaggactattgaattgtggagcgccagtcggctcatagtgggaatgagaatgcgaccccgaagttgaaggaagcggggagcgtaatgcagccgttgaaggcgagggcgaagacgccaacatggttggggggggtgtaactaagttattaaggaatgctgggaatctgagcattcacagtgcaaggtgagaccacgtgggcgcacagtcagggcgcgctgtggatggcgtgggtgcacagccggcctcatcctcagaggctgaaaaggctctcacaaggaaagtaaaagggacacaagaggttataagaggcaaatattgaaagaggaaagaggggggtctgggaataatactccgaatgaccttggacaagagaacaggaagggggcgaaagccggtttgaaaatcttgttcagctgggcaaagttccttcagtgaggtaatatagatccatgcttttcagtggctagttgcttccggtgactgtattgttacagtatttgtaatttttctgattcttggcttgattattacatactattaactattacatactatgtaccctttaggtatgtattatatctcaacacctatgtatacatacgtacataactaagggtatgtagttgatactaggtaaaaaggaaggggaaatcctagataccatttagcgctcttgatatttcacataatatcaataagtctgtacttttacggagtacaccattgtatcgagccacgggaaagcgggggtagactacatgtaccctagctggattaagttaaaatgccaagaaaaattcaagtatacaattggttgtacgcatgtcggagttggagttctatatgcatctttttatatgacagacagctaataactgggattcacatgatctccctatatttgtttctataggctcaggtcaatagtatactgaacttactgtagtgttgcatataacatgagaactgaaaccgacgatcagtgccttacaatattgggctacttaatatagatcatagtacggagttgccccgtaagcgaatatttgaccaagatgcatccacttttgataccctagaagctttcctttgccccattatgcaattaaaccaaggctttatggacttcaatatgccctcttttttatgaacaggcaaaacgtctccgaatgtgtggcgttagtccagatgctgtcctcgtgacactcaacaaccaaggaatggtcaggattttcatccatgacagctcttattatataagcagttggggtcatctagccatgtgaccggtaaggctgaaggccggtctttcattaatccggggctactttttttgggaccggtgtgtcctggcagaaccaaagtgcggagtacctctaggcccagttccggtctgccatcatctttatgtcgtgcatccaggtctacacgatcttcacattgacggagataatttcctcaatatcattctaatatccctgccaattccttgattcaacacagtgaaacgccgagaacctcccgctgggagggggtgatcgccagatgatgacgcgagctgccgcaccgccgattctgctgcagctacagagcgccgaatcggcttcctctcagattacagctttgcgcactctgaagaatgagctgattggtcatgaccaacgcaaggaaacctacgtcgtcgagggaatcatacctactttggcacaggtgctgacctcgagatggccgggaacggccgagtttaatgaatcgatattgcaccacggccggtccatgccaaaagccccagaagattacgaagcatgccttcaagcaactttagtggttggaagtttggcacaaggtgtgtgaagactagatccttgtcgccaagacagacattgactgtactgagcaggtggtccgacgttcctcaccccactattcgccagcaacattccccaaaccttactttcaatattttcctccccagactgccccgattcattctgtcttcccattctacgactcttgaacacaatcgcagaccggataccgctgcaaagccaggaacaatggcctcgggacacgcagcttgcggatcttgtttttgcttctgcaaatattacctgtcttagacgtataatctcccaggagtacaagaacctgcacagccagaccacgatcgagctagcagccgccctgatcggcaagctttgcacggaggaaacccataagacggcactagcagaatccggggtattggatgccttagccctcaagattgcctcctttgtcgtggccaagggctttgtcttgccgggtgcggaggatcgctttcaagaacccggcgtattggaggatctgccacttccggcccccgaatccgcccagctagcaccgattctgcgcgcagttgctgtgatcattgaacagtcaaaatggagggcggagcacttcctgtcatcgcctggcattgtgacggtgtttccaaaacaaatcgctggattcgctccaacagacattaagaaaggtccgtggggatccacatatctgtcgggctccgcagtaccccgtcatcttggctccaaccccatagaacagcttttgccgtcggttcctctagcacatacaaaatcatcatctagctctgcgaatttcccacctctggggcacggaggctcgcagcgccgacacagccattcttaccccacaccattttcactagctgagacacctgtcccagaagacgacgagaatgccattgttccatggctgctgtgcattctccgctcagagaatggcatgacacggttgatgtccgcccgtcttgtcacggctcttttccggttaggactggcgaagaaacatcgcatcccaatgttcagttatctgttgattcccatcttgattcgtatgcttgacaagaatgtccgattgccggatgaagaaggcgctattcacaatgggctgctctcttcgagcttacgcttaaaagaagaggcgcctgccgtattagccaacctcgtcgtggatgaccaggagctgcagagacacgcagtagaaggcaatgcgctcaagcggctttcacaacttctcaaggagacttacaacccaatcacagagacctcccggccgatgtggcacgcagaggatggcccagcccgggaccttgagtctctttcaccagagtgccgactcgggccttctggttactcgccgaccctttgccatgtaatgcgttaccgagagaacattctcaaagctttggcagcactcgttccattcaaagacgagtaccgcaaggcgatttgcgaacatggcgtagtcccttacatcattgacgccctcaagccaagacctagtgatgcactggctgatgctgcgatgcccagaaataccgcagaggacggaaatccgatccccactattctggctgcttgtggcacagctcggatgctgaccagatccgtgagcgtgttaagaactagtcttattgatgctggcgtggctaagccactatttgcccttcttcgccattccgacctcgaggtgcaaattgcagcaacggctgcgatctgtaacttggcattggacttcagtcccatgaaagaggtttgtgtatctatttcgttcatagactttgcagctaacatgctcttcttttcaggcaatcatttcccacaacatcattcccgtcctttgcgaacacgctcattcatccaacaccaaattacagattgaatcgctctgggctctcaagcacatggtttatgacaccgcaaacgacatcagaatgaacatcatcgagactttgggtcccaaatggattatggaggtcatctcccaggacccggtccgcgcagtggctggacggggggtagaagaggaggcggatcaaagtcccgggttcgccatgggtcgatccaactcagctggcgagcaggtcgatattctgaaccccatggaggatgcagcggagtgggacgaggacctcaagatgaccgataccatgcctccctccaaaatgagtctggacatgttccttcctgatgcaagacgtaggcgcaaactcgttctgcacggaactctggctcaaaccacacagtctcgacaggacgatatcgccgtccaggagcagacattcgacttgctgcgcaacatgatctgtggtcgggatgcacctgagatgattgaatatctcttcagagagcttggtcaaaatgagttcctcgatacaatcgcagatacgctgcgaccacgtaccatccaactgcctcaccgccgagactccagcagtcggtccctccatgtccctaatgagatcatcaacgcagccgccgctctcatcatccacttggcggccggacatccacgccaccgacgcatcgtcacattccaccgtgagttgctacggtctctaggcaattatttcaaccattcccacaaagacattcggtcgaactgtgtctgggtagtaatcaatctcatctacgaagaagaccagagcgatcatgaaggttgtagggagcgggcagtgagacttcgttcccttggttttgcggaacggttggctagcctcgaggatgatactgagctggacactagggagcgtacgaagactgcgctgcatttgttgaacaaactgtctcccgcatagtttcatggtttcatggcttttttatgcttagagttacccgtggacgttctggatggattggagtactgtaggaaaatgtggataattatcattattattattattgccttctcttactgtgacgatcccgtctgatatcctaactgaatataaggtcacctcaatttaatgaatatgtgcctgaaagctgtaattttcagaataagcactccattctcgatgtgggggaaaacgtcatagccctttgcaaatccggtctattcacatttgtccatcttaaatatctgttcaccaccagtctagttctttctaacaaaaatctagtgatgtctccagtaccagaacccatccttcaagccctctcactcccatccgaatcaaaagtcagcctctcgacatccggcctaggctcaggcttcacaagcacaggtatcatccacgcccagatccccggcaaaaatggcgcagaagagcgacgctacttcgtaaaaacctcatcaaatggcaaagctgcagaagaaatgttccaaggcgaatccgaatccctcaacgcaatcgcagcttcagtaccaggattctgtccgcaagccctagcttgggggccactcgacgaaccagggacaaagggcaaaacgcacttccttgtgacagagttcctccagcttggcggcaagatgggccgcagcacgagtgacgaaaccacgctcgcgcaccgcctcgggagactacataccactcccgcacccccagatccgaacaccggccggcgcagattcggatttcccgtaccgaccttctgcggagataccaagcagcccaatcggttttgtgatagctgggctgaattctatgcgaatgaaaggttgcttacaatcctggcgacatccgaagagcgcaatggacccgatgctgggctgcgcgagacggttgagaagacagcgcataaggttgtgcctcggttgcttggggttggtcatttagggtatacttccagtggtgagggggagggtatcgtgcctgttgttgttcatggggatttgtggagtgggaatgctgattggggtcggattgttggctcaggtcgcgatgagacgccgggggatgtggtgtatgacccgtcggcttgctatggacatagtgagtttgaactggggatcatgcatatgtttggtgggtttgggtctcggttctttgatcaatatcatcggattgtgccgaagactgaacctgtagcggagtatgttgatcgagtggaattgtatgaattgtgagtttctttcttctcttgctgttggacaattactgatttaatcggaaaaaaaaaaaggtatcatcatctaaatcatcatgctatttttgggggagggtatcgatctggtgctatgtcgattatgcagaagttgatcaggaagtatggaaaagactagagtctgatagttcatgcaagggtttctacttttctttttcctttttttctttttcttttttctttttctctattattttcattatcaagccagtagggttaaaataacggacacgaagcagcagaaagaagagtaactagataggacgcttagaatatgatgtcacactaatatccgaggcttgtccaactgatccctttctcactttcacctttcacttctctattaaagacgtcaaatttcatttcgcaatgccggctcatcctgattccaacctctaccctgaggccagcggcccggccaagacgctggtcgatcagcatcgcgctgaacagccattgaagctgtatgcggggtggttctgtccgtatgtccagtcccctctaatcttatacaaaaatgactgctaacatggtacaaagcttcggtgtgtgtccaaccactcatccataggcaataatattaacaaaacaaagtgcaacgagtgtggctcgccctcgaagagaaaaagattccatatgaatatatcgaggttaacccatacaacaagccagactccctactcaaattaaatcccagaggcctagtccctacactttcaacgccagcaggtccacacccacggccactgtatgaatccactgtgattctagagtatctggaagaagcatacccagaccataaaccccgcttcctgccagaggatgcctacgagcgtgcccgcgcacgtatctggattgactatgtgtcatctcggataatcccatcattccaccgtttcttgcagtatcagcctgcagatggcagtgcccagaatccagatgcggggttggaccaggctcggcaagagtttttgaatcacctgaaaacctggactaaggagatgcacgccgaagggcccttcttccttggtggggatattggtctaccggatctggtgctggctccatgggcggtacgactgtgggcgtttgatgagtttaaaaatggtggattgggaattccgagtgagggaaaagggggtccggaagaggagatttggagccggtggaggacttggctggcagccattgagagcagaaggagtgtcaaggagaccactagtgatcttgcccattaccttcccatctacaagagatatgcggataatacagctcaaagtgagttagctaaggcgacacgggctggcaggggggttccttgagggatttatgagacagtatcctgccattcatgtatatccagcatgatcaatatgtataattgcacatcctctccagggaatagagaatgacggtacacacagatataactatacacttcggaatacgggggaatgtacttccgatttgtccacacgtgattaagagctcttggacggacacgtgatcgagatatcaatccagtcacttgttgcgcgtcttcatcttgcaacttctaaagatattgcttgatattgccatattttaaggaaatccgaaaaaattgccatggcacgcaatatgagggacgagtctccccgcgggagctcgacgctggaacccagcctatcagtcccagtcatccacccgtcttttatacaggtggccaatccatacatattcgaacagacaattgaaaactgcattgaggcaatgaacgtcaatccccttcgcgaaacttcattgcgtcttcagggcgtggcatggatcgacagcgtgcggagagccctcaacctgtaagtcgtttccaagccaggcaagattcatcagaactgactggaagtccagtcccattcgcactttcgacacggcagtgggatattaccaccgttttagactggtgcatccagacaatgagtataatttcgcagtgagttttctcgggaatccgtcaaggagatcaacctaacccgggatacaggatgctgcggctgcggctctattcacagcatgcaagatcgaagatacgcttaaaaagtcgcgagacattgtctgcgcagcgtacaacttgaaagtggccccctcggagcatttatcggctgatgatcccgtaagtcgtggtacaagacgagatcagacccgagaattaacgcatgtcgctagatgtttgaatccaatgcgcgtggcatcatcggtctcgaaagactcatgttagaggcctctgggtttgactttcgaacccggcatcctcataagaccctcatgaagctgggtcggcattatggactactacaaaactccgaagtctccaatcttgcctaccgcatttcaacggatctttaccgcacatttgcacccatcaaacaaaactcatcgacgatggcttttagctgccttgagcttgcaggacgactcttggaccagcgtgtcgaacaagtagagtctgggctagactatgggcaatggagcaccagccgagctgaaatcatgggtaagtattgttattgcctttgcatacatctagtgaataccacagtattaacaataacccagaaaccctcttcgatctcctagaactctacacccaccaccgctcattaaccgccgtcggctcggaattcccagcagaccggttcctgacagtccgcattccactcaaccaagaagccagcgaacacaacatcccgcgctaccacccgtggattggccagccacgcagaccatccaacggcactgggcccaatgagccagatacttcacgacctgctcatcccttaacaccaattgccgcgaacggggaccgccagaggacaggcgagcgaggccgtgacgctgcggtgcgattcatgctcgatcccgcatgtgcggatgaggagaggcgacaggtcgcagcgtacttcaaggttgaaatggaagaatatgaagtagatggctaagagatggttcctggcacctggcgtgcctcatgcagcgagcgcagccaaaaaaaggtattggtccataggaccaatcatatagcgggcttggtgatgagcttggataagggccctatacatactacatcccatcttggtttcagccaagcaatgctctggtcacggtgactcgctgtcggctgttcgtcctgattcttattgggatacgccgatatccttgctaagctccgatggggccttcgaccgcacttctctggacagatgggcgaaacaccccagtttcttgctctgcagtttcggaactgagttatctccaacacgaggctggtattccagaaatttccccttcttgatccatatttcccacgatttcccgataccccagacatctatgaccagcaacgaattctcgatagacacaatgaaaaaatccattaactatcgataattggcttctcattgaaggacggcaccatggttgactttcgctgtacccggacctatctagagtgaaaagcttcaaaatttgaattgaaagctatgtacaaatctacggtccattcccttcgcgcgtcaaaaaacagcgaagctagagacaagaccgccgacgcgaaacagacaaaggtgtccccatcatcccctcttcttctaccacttctgtagagagacccgtccgttccacgcatcgggagtatagcagagctcaaggtcaagatggaccgagcagcacaagtcatcaaatttaggtccagtccatggcccggcaacagtcagaaagagaagagaagagaataaaaaaaaagagtactaaacaaaagtacagggaaacagtcgtaagtgaagaaagaaagaaaagatcgcccccgtgcctccggcgtggaagatgttcgctcttcgggccggttcattagagcccttgccacgggtggtttttgccgggtgttgatgccgtgttgaaaggcggtaacgcgagcggggcccatgtatgtacatatcatgcatgcacacattggcgcttgcatgcatattcggtgaacccaaatcaagtcccgaatgaagcaagaagcaagaagcaagaagcaagaggggtcgtcggcacagaaacaatcggaggatagttgcagggggaaagcgcggggttgaaaggtcgtcctcgaatggtagaagtcaaagtgaaatatgagtgtcataaatttgggtgcgttcaatctgaatgccggataattttaagttcaccgacgcttgagctcagtgaccaggcaatccagaatctaggaaaggttagtaatatgatcatggtaattggttgaaggaagcataccgattctgagacggcaccctgattgtacaagtacttgcccaagccacgaacgacctcgagctgctcgtcaactgtaagaccgttgatggcggtctcaatgatatcgcccacgctggccttgtagacagcaatgaagctgtggtagtacatgaaagagaagaagcccatgatgaattgacagtccatacggtcagtgataccgccgtggccaggaatcgactcgccaaagtccttgatcttgaaagtgcgcttcaaaccagaagcaaagaatccaccaaacggagcgatcagcgaagcgaatgtggcgaaggccaagatgtggaactggataggttccacccagaaggtcttgtccaggccaaagacttcaagagagtacggttgcaacgtgaagaccgggttcggaacacattccagaccggtcagaacattcgagcccagatcattgactggacagatgaagtacttgtagcggatcagcaagttggtcatgaaataaccaaaggcaacagtgcaggcccatgcgccaaggaatccctcaacagtcttcttcggggagagctgaatgagttgtgtctttccaaagctaataccgcagacgtaggcgaagatatcattggtgatgaccagcgcggcggggaggaagaaccagatcatgccctcgaaaatgttgttcatgacgaagtgagcttggacaacaatcaagtacaaagccatatgggtccaagcaaactgggtgaattggaatcgatagtggcccttctgcagagatccgacaaagaacacgaatcctatcgaccggggttagcggagtaaaaggggaagggtcgaaacacttacccatgacgtaaagggtgaagctgatgaagcggtggtggttcgccaacggaagtagcaccttgtcaacaagcaagatgtgcttgaagtagtaaatcacgctctctccgtacaggaaatacatagtggtcgccaagaagtaccaattcaacgatttggtgaaccgcaagttcttctccttattagggatactggcgatagcgatgacttccttgaacgagataatttggatgccagtaattagggcaataatataaatgtgaccggaaaacaaggcaacgaagaaaccggcgatcatcacaaatgtccatatcgtccgggtgatgaaggtctgcttcttcttctcatattcggattgggggggtttctagaagtgaagatcatgtcagaccgaaattccgaggtcatacttgtgctatactgaaatctaacctcttcagttattgttggtggtttggagacgttgccatttttgccggggctagtgggctctgagggtgcatcgctgacgtcggaggacacactgagacgtcgctcatcatttgaccggtgttgaaatctaacattgcggcgagatttcgacatgatgtagaaaagggggccagaaacagaattctggacaatagaagtggagagtgcagagagcgagagaggatcatcggattagaagttcatgagctcatgtgaagtgccgaaagcggtcagcttcagcttcagccccgtgtttactttactctttttcttttttttttcttttttttttttttcttggcttgtagttattatacctcggtgtatcatgcgggtttattgagtcaatcattacttggccttcaagtattacattcgtgactagaaattgaaattggatgtgcaagggttgtcatccagctgccttgaactgccgtgttttctctctccctccttattcaaccctcggaaccactccaagtcgagaatgatcaaaagccctccgtgaacttagaacccctcgattccctctggtagtccattcatggcgggggcatggaagacgacgacgacgactacggctccgatgagttcgactccctgccaccggggacgttgtatgagctggaacagaatgcgttccaggcaactcaggcatcggcctcacagtatcactcaaaacccctaagtagcaaccccttgctacgcactcaagcagtgccattaaacaacaatgctggatcgctgagaccgccgcctcgcctacataccgggttgacgaacgactacaatacactggaggtgggggagttggaagccgaggtgtacgataatgtcgataaaccccatgctattcctcatggtcaacatgtgctcgcaacgaatcctcgatttgcggtcaacgagcagttgggcgatgccatggatgtggacgagtactatgggcaagggaacgccgccgctgagctcaatgcacgcctagtacaggtgagttagatgaaaatttctttgtataaactctaacaaccttcatagatggagcaagaaagagaacgaatgttacaggagttagctgaagcgaggatgcaagtggaaacgaaggccggtgaaatctcgatcattcgaaggaaacaggcgacgatgacccaagactatgacctgcaaatagcgtctttacggaaatccatggccgatgaaatggcgaaacacaagcaagaagttgaggcagccatgtccgaaggcaagatattggcgacggagaatgtatttcttcaacaggatctcgtggatgaagcctaccagcttcgaaactacaagtccaagcatcgcgaggtggaagccccagtgacgccccgaaagtcccgggttcttcccttccgcgatggatttgatgatgatgaaattgccatgatatcgcccagcaagtctgcagcacgttccaagcgagccacgccgacagtcccaggaaaacgtaaacggcaatcaagccaagatgcccctgcgccactgcagttgaatcctgctggcgtggagcttattatggccgatgcgactgatgctccggccgaagtcgacgtggcgaagcgcaagtctgcagaggcgggtcgcaaccagcgacttatgatgcgacttttgagccaccgtacgcatcccaaccaagaaaccgatttcgaagccatggccaagcttgcatttccctcggaaccgcatcgacccatgtccagcatcattatggaggtcatggctcgtgccgacccgagcagctacgtattagaatacacgcaaacgattgcctcgctatggcagcgcgccatcagcgagaagttctacgagccgatcccccgatttgaagctatcacaagatacagtttgatgtcggatgatgtcccgctctctgagctgatcacacctttagtcggagtcttgcaagacaccgtggaagtgaatgcagttcctcgcttcaagtacgccccggcatcgcgagataagcgaattactcgacagacaccacaatcagatctgcagcccctggttgactcgactggggccatgcgtttactttaccaaatcgcctgcggagtattgcatataaagagtgcaatggagacattctggcaaaatatccggatctcgttcattctcgtgatgctgcacccgtcacatccactgggtgacattgtgcttttgatgaatctcctgtcaacaagtattcgagcagactccttcggtccgattaggacttctgaccaggaccaattggacgtgcaaaagtggattgtggaccgcctcacacacatgctgagtgagcccgcaataccggacgaagggatagagccgtacactgcatacgacatttgtgcgatgcgcctcgaggtcctgctgctgctggaatcgctgacattcaaccctatggccccatcccaaaagcatgccagtatgatcctcgcattacacccgaatgcactcgctcgtttattccggtcaatgcacgatgagctggatgcactttactcctccccgccagagtcagacctgcgtgttgcactggtcaatggccttatgcggctgattttcggggtcatgcggcaacatggcaccttgatcaatatgcaggagaagctggcgtgtgtacctggcagcaaacagaaacatctcgttgtgttaactcgcttggcgttttgcgatgggactgtgctggaggcgggcatcgatgatgaaaccgttgatatggcgcacgagctactggaggaatggactaatccccaagaagcagagtcattagcggaggccttcccaagttctaggagagactgacacagtgagaacaagacgtttaatgttgaacgactgggagttttgtatgcatttgacatggcgtaatgagttctctggagttactagcatattcctttaccatataccagaacaatttcattttcttttacaagcattcaagatataagggaaaagctacagagacgtagctccataagaggtttgagacatccaacagacgtgagctgcaacagttgcagggttttcactatccgagtcccattactccagcaggttcccacctctcagtggttaaaactgtgcagtaagggaccaggaaagggaatcaagtgggtcatgtctagaggataggggcttggagacattgtacaacataggcaccacacgacgcgtcagacacgtcctggtgggatttctaggagggacgatctgtcagagcttcatcgacagagtcaacaacattaaggggccatgagaatggggagatccttcaggggaggggagagcatcgatagaacacaacaaggcttcctggtctcacttcaaaggcctatcatgactacatgtacagtgcttcatatgccaactacgaatatcctcttctccaagatcgagccactggcccaaggattgatgaaaagaaaagactccacgaatggaggtgccaaagaatacgcctgtcaatgacccataaagaaccattgaacagactgttccgccacgctgtgcaatgcagggaccagtctgtggtgagaacgtcttgttgatcacggtcacccaaacaaggtaagtatgaagaagaaagaaaaagagaggaagagccgggggccaggcgcctatatatacccctttctacagggcggtggcagaatctgcccaggcaaacatcgagttccccttacatgatatgcaaactagacaaacatccaatagttagttaagttatctgccgccctatttttcaggcatcaatttcctagcagtcacgtgcattgaagttttgagactctgccaaattggccctgggtaacatattatttgctacagcattgtgtctaacgagtcgccacaatgagaaacagagccagcaacacattgtcgaaaggcgtatgtcttcctactatactgggttgtcccaattccaataaggctaacaagacactggtcagaaaatccgtcaatcatggagcaaatacaacctgtataacatgcaacgattccgcagcccacccaccaccaatcgcacattcttccagcagaaatggtctgctaaggctgcctcccgtgcctatcacggcgagcaggtccgtgagggacagtggaaacgcatgttcaaccatcgcattcgcagtgttatcccgatgaatgcatccgacttggccgctgatgacggttccctagtctcgtccggccgaggctcaggacttgataagggtggaaagcccgcttaccagacacgtcctacaccttacacccacatgacctttgcacccctggagcgccggttggatgtagccatcttccgagctctgtttgctagcagtgccagacaggcgagacagttcgtcatccacggagcggtcactgttaatgggcaaaaggtatgatgcgatatgggaagctaccgattccttgattactgactcgcttttgtgttactagatgaaacaccccagctacctcctcaaccccggtgacctcttccaggtcgacccagaccgtgtcttgtacgctactggtcacacgaaaactccgtacgagcgacgccagggccgattgactcggagaaaagctaaggccgagagctcaaagggagccgaggaagccgaggccgcaccggagaccgccaaggaagagaccaaggagactgaaaaggaagatactaaggagactgaaaaggaagatactaaggagactctcaaggcgcttctggcacaggctaagtctgtcatgtctgcaggcaagaacacactcgcgccccagcgcaagcaggagctacgcggtttccaacaagccgtccgccgcgtattgtcccgctccgagtccagtaccgtcctcgctgacagcctggaggcccagttctcccagctaaccctgcttctcaaggccaaacggagcgagaagccagagaagaaggatgtgaagccccgtcccgaagatgctttcgccaccgacaggggagatgcagaggtggcttccgcgaagaaagatacagaagccacagccagcgacaagctctccgaagccttcgcgcaggcaacgctgggtaatgaggtggatgcctcggaactcagcgacgaagagttcgacacgctcaagcgcgcccttactcaaatgcgcgacaaccctctcgacaacagcaagacctactccaccccctggcagccacgccaatacatgtctgcttttgccttcatcccgcgctacctcgaggtcaaccagaacatttgtgcagccgtgtacctgcgccaccccgtggcccgccccggttccgccgaggtgcccactcccttcggcgagtccattgccactccggcttatggctggtacctgaggagacggtggtagaggatgcgattggcttgtctttctctgcctagcctgtccctatctcgtttctctctactgttctactgttctactatttttctctcccctaaacttcccgtctgtgtattagtgggcgcttagatctccctccctttctgcatatttctggatcatgttgaccatggtgttggttcctgttttgcttgtctttggggctctttgtgtcagctctaccccctgtaccaccatagccatgatgtgttataaatggatatattattgaagctattgtttcatgctgtatattggccggtcatttgtatggtccttgagtagacctggcgactttcctcccttgttgtgggtggatattgtgccaaacagcctgttcttgatgtactgctggattctaaatccatagaagatattaagaaccttacgcaaagttgtaggaacacgataatactcgtaggcaattacctacctccaacataaagttggtcgagtgtccaatatatactcctccgtacaccgcacttatataaatatgcagccaatggatactacctaggtagaatcccacaggaactctataactcaaacggtacatataattaagtacaatctaaacatcgccaatgtgtaagattgtccaattgaagctctacaagattgtatagttagccagagctgcaatagatgcttggcgcacggacccccctagaaaaccctcaagtgaaatccatcgcagctttatctttatccccacagatcgacaaggacattctacattagtctgctacactattgtcaccctattgatggctactttgaactaaggaggctatctcctggaccccataggccagccaacttgcactgttggtctcccatagcgcctgttcgactgctattgctactgcgaaagctgctatcctcatgacgcgcattcaaccacacgaatacggccatccttcgtaccaccctccacaaaattcctttggaacagtaccatctggcctgcgctcagggttcagcccagcctctcagtccgtgtctgtggtagtgaggaatccacctacgtctgataacgcatcggcgagcagcgaagagacacctggaggggcaaatctgaccggaagtgattcacgtgaaggagacatcctccaaaccgatctatactatgcgccgatgccggtgggcgtagctcaagccagcgaaggagatggatcaagactgatgtcgggaccgaccaccaacagagggacgaagcgcagtcacaacggcgacgatgagctcaatggcgacacttcacgacagcatagacgtctcaccaccaaagaagaagtagcgctcttcgagatctgcaaccgaaacgcagacaccttcggcagccgcagtaatctgtgcaagtggtggatatccattgccgccgagttcaaacgtacccatgagggccgttcatactcgtggcattcggtgcggcgcaaagttgaaatggttacgaggcagcgcatcaagttcctggaggaccagagacagcggggctcaaacgcacccggttcgacggccgaggaattgatgaacccgcaatggttagctgccgtcgatgcctggcttccgacctggcagcggtgggaagaatccgaaaaccggcgtattgcaaagcgggatgagctcaagaagcgcagacagccgcagccctggcgccagaattcgaataatggagaccaggaaccatggcggaacctggctggaccatctgccactagcccgactgatgccaacggcgcaatgatgggtatgctacaccaacctattgcgaataacgtcggtgacgctaccctcccggctaccagccccacgccttcgccctcaattactggccctgcaccacccgcgcatttcctcgaatcaccctccacccctgtctctgcgagcacatcactgagactgccaccgggtttcgagaatatgttctcaaccccacaaagcacatcaaaagtcgcgccccttccctccatatccacaccaccagttccacaacccgacggccgtatggtctcagccgtcctcgaaaccctgggaaaactcaacaaacacctagactccacatcggggggtggtatagacccgagtgtcacctcacctgtgatctcggccttggtgcaggccgcctctgaaccaccggttctagcttctccacggcaatcacagcacccgcaagtacagcctacgttacaaccacagccacagcaaggtcctactcacacccagcttgagcaaatgaaggaagagctacgtcaggagatgcaggcccagtttcgaagcgaactggagcgcgaacgtgttgctatggaggaaaagctggactctgtgcagcggacccaggacctgattcttgagatgttgagacaagagcctgcttgatgcagatggagtcttaagtcttgtactttttctctaggcgtggcttgtgttgtctggcttctattcttacttgtacttctactttcwctttttctttctgatatgatacccattatcgactgcgaaggacggcgggcctgccatatcttcgagagggctgatattgctacccaagtctttacttgatattctcgatgaagacattgcaagactacttcctaaaatttgacgagcttgaaaaggacccagccgatggcaattgctctctactctagaacagaaaacaagtaaacaaacataagagaaaatagtcatcgggctaaattacagataaatgatagaacgacccaagaattccttcccgagccttcacacaacgattaaaagctctttcacgatgcacagaagtgcctatagcgcgaaacaatctagtagtagaaggtctcatcgacggtacgaccacgcatccacttgggctcagagccacggacgtagatgtcctcgaagagaatgcgggaagtgttatcggggacgggcatcttctcagcctcggcgacctcggcgtcgacgttggcacgggcggtcttgtcgagacccttgagctcctcctcggaggtgacgccccactcgagcatcttctgcttgagaccagcgatggggtcatgggtgctgcgcatgcgctggatctcctctcggctgcggtaggtggtaccggggtcggacatggagtggccaccgtaacggtaggtgacgtactctagaacgaggggtccgttgccggtgatggcgtagttcttgctgtactggacggcggccttggtggcaaggacgtccatgccgttgaccttcagaccggggatgtactggccgcgcttgtagtactcggtcagagcggaggagcgagaggcggaggtacccatgccgtacttgttgtctagagaaacataaacgttaatacatctgtggcttttctgaggctgtaaagtcttggaatagaccacttactctcacaaccgaagagaacgggcaggttccagagcttggccatgttgaaggcctcgaagacctgaccctggttggaggcaccgtcaccgtagagaacgatggaggtgttgggctgctcgttgtactgctgggcgaaggccagaccagcaccgacgggcacctgggcaccgacgataccgttaccaccgtagaagttctcggcgaacatgtgcatggaaccaccctttccgtacgcgataccctcgcggcggccgagaagctcaccaatgatggacttgacggtaccaccacgcatcatagcgaaaccgtggcaacggtaagcggtaataaccttgtccatgcgggtgatggcgtgctcaattccgacagcgacggcttcctgtccggtcgacagatggcagaaaccccggatcttcttctccttgtacagacgatcggcggccatctccatacgtctgcaaaaagaacgagcagtcagtcaacggctagtccaaaacatccgctattctgcttatcgtacctcatcgcgaccatgtcgtagtacatctgcttgagctccttcttggaggtctcgagagtgtacgagggtgggtcgagctcgtaggtctcgaagctctcatcggagagacggacagtgaacggcttatcatcctcctgttaaagcgcaagcacaagcatcagcaattgaaactccggaacctttggggcgaggtttttcagatcttccggatagggctcaacaaacctgcggcaccgggctctcgacgttggcggaagcggcgtcggtggtaacagtgcgacgggcaagaggagtgaaggcacgacgcctcaagggcgcagcctgacggaccgcagcacggaagagcattttgtgagggaattggagatggtacgttgtagatgataagcacctttttccgtcccaacaactctcttcaattttgccgtcttagtcagcttccagatcggggccgcccggtgaggaacgtcaggccggctccgatgttaaactacttgacttcgctgaacattgattctcctatatttgctcggatatttcttgtatctggtgattaattcccttggaattatcaaaatgggccatcgcagttaacaaatggcatctctgttgtgcttgcctgagattttgttctggtttcgatctccggtccaaccccaacggttcgattcacctctatataccatagcaacttcaaccctttggcgacaagaagatagaattcaagatcctctggggaactaatcacctcttcgatacctgtaggtcattggatctgcttgtagcgagcttaacaagcaataatcttctagaaccaaatatatgttgcatacaaggctgggatatatcagtgatcaagagggcaccatactaacaacctaatttggtaaacggtcaaaattacattagcagtcatgagaacagagtctcagacaatcagacttgaatatgccaaagttcgaagtatgtctgttttcgactgtgaggcagaaaaaggccacccccaaatggatatcaaaaggcagttgacaccaaccccaaggtctattgagacgaatagctattgagagtctcaaaaggcaaaaccgtccttctcacatgtcctcttcaacaactccaagattcttactcatatgaataagatcccaagatgatgctttattgactttattgactctattgactttccaaatggaagtgcagtttgttcaggcactgcgtgtcgaaggccgggcctcattatttaaaatgctggcttctcccttcattgtcctcttttttctttgcatcagcttctgaaccggtgtgaccaaggtatctttgcaccatgcctctatctaaggacaggaagctaacaaacatcaagcagcaccaatctcgatatggcggaatccactgccagcgcaccccttccgttgggtcctcccgctggccctcccatcggcactgctatggaacctctggttgtgttcgttgctcgtggcgctccgggccccacacacgtcgacatcggccagatgaagtactaccttcgtcccgccctgattgagctccagggaaagttccagcgcaagtatggggatctggaaggacgttcctactgctactgcccattgattcataaatcaatcacccaccttgagccagattccgactcgttcaagtctctgaccgatatcctcatgtatggccggatccatagctgcgacatcatgtttgtcttgaaccactgggacgccatcacctccgacggaccgagctttgccaatatcttcaaaggtttcaccgacgtcaaagtgaccattcgcgcccacggcacgatttcagcggaccacaattgcgaattccacgacctcgacgcccacaaagtcagcgctcactaccagggcttgatccgactggaagaacagtttcttattgatgatgcactgcgttacgtggtcagagtcgaagaagtccgtggagtcaggatcggagtggaggagtcggttaccctgatgagggacttgactggcgaacctgaggaacagctgctggagagagtgcagtggttgctttgatacagggaaaatgaactgaggaaatgggctcttggatattcatggagatgtgaggaactctgacgacggacgttttccctccatgggttgagacatgtgattctatgccaaagttcctttatccgagggttaaagccccgattgtaccttagcgccagctttgagaaagctcacttacaacgcccgagcaagccttgagctctgcttgtctttgggatcaaatgaaaccgttaatacattgatatctctttactttcggtaaatgattatttgaagtatcgtacggtgtagaccatggatcgtgttcgccctgaacgtcttcatttttagccaaagccgaaatcggttccatcatgggttgtatatgagaacccgtggagctgtcgacggccaagcaattgcttacctatgtacctattagaatccattcatactgaccatgaaaatacaagtcaaacctcatcaagagctttaggctaacacaactctgcctacacaccaatcggacgacacccatacaccacaagcgttagaacgctgttataccaaccatacgatctcaacagcttgcattgtgtagggcgttgatagccgagccaattgaaacatacacatctaaagtacgaactcgacacgtcataccggcacaatcaaagccgttgaacaaagatcaggaaagacatgtcgtattgacctaacgctcaaacgaaatacgtgtcaaaaagtatcaatgcacaaagtacggagtcaagaacagatgtatccgaaattaccccgcgagtgtaaaagtgatggatcttaaacacactacaacatagacgccattggcactccattggcactatcgggggaaaaggcaggataccaaagcccgacatctgaattggcgaataacgccacgtctccatcggttcgtgcattggctcaagtttatccataacttagttatattaacttatattaatttattccaacggccacgttaacctttacaaatgatagacctgaaacaccgtgttgattcaggtaagttcaggtaagacagattgcgatcgaataagactcatagtggcccaagctgatgggattcaagccatcccgccgtaggacccttacctactccgtaccttgtgtgagggtctgtgtgtgagagaacgagtggtgaaggagcaccctaaaggatctgaaccatccgcttgcacggacgatctgcgttgcaggtgtacactggactacccttttctgaaaccaacccggtcgattgtagagctatcagcgtcatcggacgcaccgttgtcttaaaaagacacattgacttgtgacagaaatcagttctggattagcccaaccccgaaggatctatatcctcgtcatgaagtagctgcagtctactgcatctactgaactttggtcacaatttcaagtcctcgagtcttttatgctaacgattatcggttcgggatcagcctggccaatgagacctgcatggatatgcagttacctgcaggtaggaaccaatcaaccgtatttactattaagggattacagggttgcatttctaaacttatgtatgtacggagtgcggagtacaaagtaagagaatgctagatgatagcccggaggtatcatggtgattatgtcacttccaagttggtcaattcttttacaagcgactagttcgtactctgaaacactggaccactacaacatacagaattgagaaagagggaaaggatcaaccggctaaaaggagttagactgtgtttacattactatctccgctatggaaactttcaacggtgatgatcattgatctatgcgcttcaatatccaaagtacatctatacatatatgtggatcgttgtacagagtactccgtattgttgtaagaagaatagccgtgttaattttgacggtctagagccaacacagccaactgagctgtcagatagggtttgccacaactctatatgcctagacttgacagctccagggccgagcagcaaggatttgttaccagtcaactccgctcttgtccgttctttgtagttgcaattagcctgcatagtaattctccgacgcagatgacgcgcaggccagcatagggggtgtaccgacatagtttgtgatagatccaatatcaaaaccccacctcaaaagggggaggcgttgccaatcgtcatctaccacgaggatttgacaatttatgcagagcactcattgacgatgccttcggcaagccaggattccgagacaatggagaagtagctaaactgagcacagacactgtgcagcaaccaaaaaaccagaaacatagaaaacataggagtatgtcgatcaccgcgtaaacgacattcgcacccacccgggcaacggaacgacccataaacggggagctgcagttaatgatgtgcaaatcaatttctcctagtttcgcgtctcctattactaggacagatgatttaagcgctaacgagtgggacaaaatacgatagacccgccggtgtcgaattgcaggcgcgacgagggagatcaggagttaaagcgaagacgagccacaccaattaggccaaggggattttctgttgacccttgacccattttctgggagctcgggaagtggcctaccatgtggcttatagcagaaaatatccgttggagtccgctgctggaggagtgatcgtcaaaactccggaggagtgtctatacgcccatttaggatatccaaagccgaggaccaattttgttgttccaggtgtcacacggacttgggcttgaagccggggtaaagggtaaaccctggaatagtcgaagagaaattgcgtcattgcagaaatgatttcgaccaaaggaataaagtctccgttttccagaatccccaggacaacttttgacagggaaagcccggaggatcgacagagaaccttgggaatttgccactgttccaggagcgtggtccttagccaatatagggtgggtatacggctagtggataaatgagccgcctacaaccacgtgagtcggtaattagtatattagcggatattaaattaatccgatccgaagtaaatccactcgtcaaccttgttatcaccactcacggatttaggtttcccgttcttggactggagtaattcctaaggttagggccccggtggattcgccgaatatttgagtattgagagtccatggaaaagatatggaaaggatgtggatagccccgaaagaagcaacttttggaaagatttaagagagttatgaattgcagaagaggtgaatgaataatacaaatgtctccgtactcccgctactccatttgttctccatagtaaattaattaacccgatttcaggatcagatcccttaaatggattgtaaagccgatcggatatccgtgtcgtgtccgaagagggaagtagagtaccgagggttgagtatgcatatttgcacatgtacatatgcatctaatcgtatactacatactccgtacaacatacaacatacaagaataaagattaataagataacttctgataataaggggtgcaataaggctaaccttggaaccttcagatgtttggaaccgtaaaaatatcaattcaggggatctccaccaccatatccatggttcagagtgggacttattgtactagtaagatcttgaccaattccatggtttttcttctttttttggtttttcttttggtttttttcctggtctttttgatttttttggtcttttggtctttttctttttttgaatttcctttttgcaatttattttcccatgtggtccactctaaacgtgtggtgtatactccgtactccgtgtgcccccctgttcagctcttcctcatcttgtatacactattacacttgaaatgtttggattttaattattattctattttctgtttaattattttctggtttattatttttttgattactttttgctcctgaaggttcgccttgttatttttttttctttcttttcccccccacctctttgtttcctttgagtcgatgtggaaacgttcacctagatcggaggactactctgggaacgactcaactcaacatcatctatctgagctgggtttcctaggtcgatccagaaagtccaaaagtaagtgtgttctgtctctatgtctctcttctattcttctatcagagttgggatttcccagtcttggaaatgtcctagatctgagactattgtggcctgttctagatgcctatgggataaatcggactaaaaccaccctcccctgagtactagtattgtttggggtgtttttcttttttactctccctcttatccacatcctcaatccttttgtgcttctgcaaaatagcctcaatccgctattagtcttgaagagtccccaccttgctaaccaggttacctgtgacgtacagaatttcaattgcagccagaatcatcctctcgttcacctctccgttcatttcgttcactcagtcgaggcgtgatagaccgacctagcagcagtctttccaaccagaccgatattacccggagagcaccttcgactgtcgctggatcgattaattctgcctacccagaacccggtcaacttgcgcattcaaatcgctcacgcacatcatttcattcaagatcgggacggaccaccggcctaatggaggtagaccgcacccacacgcggagggagaggacctttgtcgggagcgaatgcgctgtctgtgaggaaccattggaacataccctacgcggcgagcgtgttctgcagctctcgtgtgcccatgtctcccacgaggcctgtttctatgaatttctacgggaatgcgatggacaatactgcccaacttgcaatgcgccattggccttggacacgagtcgcggcggaaatgtcttggatatcggtatgtctctcgtgcggggttcagaggggaggaccagaaggctaatatgattcaccagagaaaattagtaatattgttcgttcagtgacgtcgaatgataccgcaacggtacgcagtggcttgacaacacctactccatgggagccgtccagtcgacgagcaccgagtgaatccggcagtcgctacacctcgggtacccgggagccaccttacacgagggacgcatcttacaacccctcggcaaaggaaccaccctacaacccctcgagagattcatcctataatcgacgagatagccgtgataccagcagccagcgtgagcgcgtagagcgattgaccgtgggctctaaccctcgtcaaccccactcccggaacggcagcgcggccggctcatcgggcgaatacaatgaaggacaccacgccagtgggcggcgtcatgattacgatgtgcaagctatggagtcagacctcagtcctcgccccaaggtcgccaagaatcccattcctgcgccgatagtcactgtccgaagcgagtttccaactatgaatcgatctcgccaacagcagaccctcacgtgtctgattacggtcgaggtgcccgacgccaattggcgtcctgacttggatgacctacggcacacgccttccggacagtcgcagccggatgaggcatatgcaggacgatttggtggcggacaggatgctcgatcgatccagtatgagccaacggagaatatggaagaggtggccgaggaattgcgcaaccgagtggacaattggcacggtcttgagttccaacggttcggcaagctgcgcctccacggacacatgcgcgtgggcaaggatcgggattcctggcaggagttggaatgctatctcttcggcgagatgcttatttgtgtcaaggagaagaaatcgggtgactcccaatttgatgcaaccgggcgacgcaagcctgttcgttgcagtctgaagggctcgatattgattaagaagcatttaaagtccatcgaggtgtcgccagatgaacctattctctccttaaacctttctgtcactgagctgccctgtttctaccttcgcttccagaatcgcaaccagcttgaaatatggcgtcggtctttgatcgatttgcacccagaggccatttcacgccacaatgactatgactacgacaactcgggggcggaggaggatgactaccgcggtagccgtggaatccaacgacaagcttctatcaattcgtcttacggggcaggaaaatccatcaataccgccattacagactacaccaaccccgactacgccagccccgatgcagaattccctgccatcaacactgttcatatccccctcgatcttgtcgtggtcattccggtgtcctcgtctatgcaaggcttgaagattactctcctgcgcgatgccctcaaattcctcgtgcagaatctcggccctcgggaccggatgggcctcgtgacttttggctcgagtggtggaggggtgcccctggttggtatgaccaccaagtcctgggctggatggtccaagatcttggaatcgatccggccggttggccaaaagagtctccgcgcggacgtggttgaaggtgcaaatgtcgccatggatcttctgatgcagcgcaaattcaacaaccccgtctcgaccattcttctgatcagcgactcttctatctccgaccctgaaagcgttgatttcgtggtctcccgtgcggaagctgccaaggtcaccatccactcctttggacttgggttgacccacaaacccgataccatgatcgagttgtctactcgtaccaagggatcttattcgtatgtgaaggattggatgatgttgcgagaatgtgttgctggatgcctgggtgcgttgcagacaacctcccaccaaaacgtcaagttgaagctccgtctacctgaagggtcacccgccaagtttgtcaagattagcggcgctcttcacaccacaaagcgtgcaactggcaaagatgcggaagccgcactgggagatcttcggttcggcgacaagcgcgacgtcttggttcaacttgtcatccagcccgacaacgctacgcaggacaacatgccgcaggatccgtgggagagcctagtctccggattggaggctctcggcggctgttccgatggtgacgagggccgagtcttaagtgttgaagaggtcccattgatccaggctgatctaacctacggcgacctgctccgcgatggccatctcacccactccccccgcccttcactcctggccattaccatgttgcctcctaatcctcgggccaacggccagcgatcctcgacccctccaattcctcctcatccctcgatcgtgcagcgccggatggagctactcacttccgacatgctgacccgtgctctcacgctggtttctcggggccagcatgaccgcgcaatgcacctcctcaacgaaacccgcagcatcctcaaaggcctgggcaagggtggcctaccacctctgcccccgggtgcttccaagtctgacgatgccgatagccgcggcgacactcccgtctcggcctcctcccctaaatcgtctacctttggcggaacccattcatccgcatccgacaccaacaccatcacgccagcctccgcagtcgatgctcagacgatgattgccctgaacgctgatctggaatcgtccctggagtggatcaaccacccggcagtcttcgggcgtgattcacgcaaggcagtgctccagagcattggtgtgatctcctcacagcgcgcctacaccttccgcactccatccgaagctcactgggcccagcgtgtttctggtgtgcgtcggttgacggagcgatcccaagactggcgagagactggtgacgatgctttgactgaggagtagggtgtcgactctccgcaactcaacacatatttctcctccctcttatttttgacttctgaaacgttccccttgtgtcatattcccgactttctacatacatgtcgagtcgacattatttcccctgtgtttcttacccccctttgcgatttctctttgcgatttcttttgccatccctatgataccactttgttcccatgactatgcaacatgataccaggggctctattcttgatgtgtttccgttgtattggacataacatctctgtttctatgtaattgctctgacggtctcggctatggtgcgcgggtgggatggggttctgtcggttttctcctttaactgtttgaacatatgacgatttaccggacttctctttctttttctatacatccagccttgctagtttatctgaacctattacctagttgccttggattagtatataacctcatcgaaacgattctttggttccagcctcaatatctcaggtggatcaactcatgggcctaaatgtatgtgttgcgagagcaagagatctttaggtagtgagttgtgtctttgttgcctttctgggtcgattcgaataaggacgtaggatatcctcacaatagaggatcgaaggttggagacatcttatggatgacgttgatcccaggctacggaatgtggctgcttatcgtcgtgtggctcagttcggaccttcaacttgcaacttccccggggaggtttggttgagctagaccattgcaaaatccttgaatcctcttcctgacaacatctaatatagagctaaacaggctctcgaccatgctccgtcaatctatggcgcgcgcattccgcagcgcatgcgcataccagttcttatcgccgaagccctccacccacttcaaggccgcctcaccagcagctcaaacatcacgcttatccaataccctgggccctcgactctttacccgttgggctacctctctgcactctcaaatcgcacccctacgacaacgccgactccaatcacaactctcattccacacaccttccccgagcgaccggcgcactttcttctcaagccataaatctccttaccaacaaaggcagaaccaatacaaccgattccgagggagctcccgacaacctctcgtcttccgcttagtgcagaatgcaaaaccgcaccactttgttattattggcgtggggatatcgggactctatctatacaacacggagatagtggagatgaccggtcgacgacggttcaactgcgtctctcgtcaccaagagctcaacatgggcgaagagagttatcgcgaggttctcaatgccgagcgtggaaagatcctgccccataaccatcctcttactcgcatggttgatggtgtcctgcagcggttgatcccgcaagtggatatcgagggcgctgattggaaggttcatgttatcaaggacgatggaatggtcaatgcttttgtacttcctgggtacgttttactggatgtttgggttctatagttgtggatgtggctaacattgtcttgcttcgcttaggggaaaggtattcgtctacacgggtatcttgcccatttgcaaagacgaggatggcttggctgctgtgctgggacatgagattgctcacgtcgtggcccaccatcccgcagagcgtatgagcaacagtttcattaccctaggagctgtgttcgctatctctttcttgttcgatgtctccggacagttttcctctttccttttaaacctcatgtatagcttgccaaactcgcggacgcaagaggtatagttggttcttcgctttcattctacggccacttggctaatttctgtttacaggctgaagcagacaatatcggactaagtatgaacccttgaagttaggatcaacttgcgattgtgtcgctaacaattgtctccagtgatgatgtccaaagcctgtttcaaccctgaggccgccgtcaaactgtgagtcgacatgacatgtgttagcgtcttggactttgctgataatttctagatgggctcgcatgcatgaacaggagaaacaggcccctccacagttcatgtccactcacccaacggtaggcgtagaaaagttccatacgtggatgatagctaattcatagcagagttacaaccgaatggaagccattcaaggatggtatgaccatttcccctgcgttgacttattgactgttactaattcgaccacataggctccacaaggccgaagcaacctacgaggagaatgggtgcagctctgttaaaggatacagtaagagtttcttcctttgttcgatatactaagttgctaataatcctagtgcctggtttccgaactgcttataattcacaaatctcatatttgagatgatcaagcatccaagtcaatagtgcaattgatggtaactgcacatgtgtataatagcattagtcgatgtattaataaacatgagagaatctcccattacagacctcctgagacataaagtaaaatcatatcaaacatacaaagtatgaaggattataagattgtaaagttgctgatctatagcaagacgccaagcaactgggcaactggcgggctccccctcgtgcaaaccgagcaaacccaccaccgcagctccaaaaattgcccggcacaacagctccatccactccctcacattcaacccatttgatatccagtcgcatctccttcggacgcgacctaatatcatgtcgctatcaattccaggtccctcccaggcggggctcttcaagcccgggtaccagaggtgagttcgaaaagtcggggagccagaaagcccaccgcaatagggacctccctatctggcgcccctcaaaaagaagcaaagcaattggctgatctgtgtttcctaccatatagtcacgatgctgaagatggagccgttatccgtaacatcgaagcctgccaggctatctcaggaaccgtccagacctccctgggcccctatggccgcaacaagatcgtcatcaaccacctgcaaaagatgattctgacctccgatgcggccactattcttcgtgagttggatgttgttcaccccgctgctaagctacttgttatggcgagtcagcagcaggatgcggagatgggcgatggtaccaacttggttattgtgttggccggggagttgttgaaaaaggcagaggagttgatccgtatgggcctcaagacgagtgatattgtttctggatacgagaaggctcagaactatgcctcgaaggttctagagggtatgtttcccaaccgcccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctctctctctctctctccttccattatgctttgtggatatacaagtatacaagtgggggaatgtttctgactttatctagaccttgaggtcgacagactccaggaaatacgatcggcaacagatttgagcaaggctctccgcacagtggtggcttctaagcagtccggtacggaagatgctttggctgcgttggttgcggaggctgttctggctgtgttgcccaggaaccccgctaacttcaacgtcgacaacgtgcgagttgttaagatcatgggtggtagcttggaacagtcaaaggtggtgaagggtatggtcttcccccgggagcccgatggaactatcaagaaggccaccaaggccaaggtcggcgttttcagctgccccatcgatatcagccagaccgagaccaagggcacagttctcctgaagaatgcccaggagatgatggacttcacctcgggtgaggaggatcgtctggagattgctattaaggagctttacgattccggcctccgcgtggtcgttgccggttccactgttggcgacttggccatgcactacctcaaccgtttcaatatcctggtcattaagattctgtccaagttcgagctccgccgcctgtgccgcgttgtcggcgccacacctctggctcgtctgggcgcccccatgcccgatgagatgggccagatcgatgttgtcgagacgaccgagattggcggtgaccgagtgaccgtcttccgccaggaggatgttaacgccatcacccgcacagcaaccattgtcttgcgcggtgccacccagaaccacttggaggacgtcgagcgtgccatcgacgacggcgtcaacgtcgtcaaggccatcaccaaggacccccgtctcgtgcccggtgccggtgcaacggagatcgagctcgtcgagcgcatctccaacttcgccgaccgaacccccggtctgccccagtacgccatccgcaagttcgccgaggccttcgaggtcgttccccgcacactcgccgagtctgctggtcttgatgccaccgaggttctctcgcgtctgtacaccgcacaccaccgcgccagtgctcctggcgagtcatcttccgaggaggatgaggaggagggctcgtctgaagaggaggaaccctactggactacgggtgtggaccttgagattggcgactccgatggcactctggacactgtcgaggagggtattctagatcttatggctacgaagatgtctgcgatccgtctggccagtgaggctgcccggacggtgctgagcgtcgaccaaatcattgtctcgagacaggcaggaggacccaagcctccgcagggtggaggtgattgggaccaggactaaattttctttaaaaaaaggagcgatgagggtctggatgctgtttgataatatgaggcctatagatcttcgtacgatgatacgctttttgagaaccactgtaaattggactacctttctcttccagtactttttctttgctttcttcatagatactctctacagatatcttatacaatgaaaaggatatcagaattgagttgatcatacctttaactaactatagttagtgctacggcggtgtttgcctgatagttagttagataaacatatttgcctgaggcacaacaaatgatcacgtgccactcccagattttcctcgagtgtttcctttcggtcttgatatcaacgagccgcgattccaatccccaccactttcctctgattttcctttctctcgggcttctctcgttatcacctccgccatgtccttctccacccaggccgcagcccgctgcgccagacagctctccggctccgtccgcccgtcctccctgcgcatcgcgacctccgctacatacctcacagcccgtggcacacctagcagccggcgatgcgaatccaccgaggcagcccctgctgctaccaccaaccccaagatttcccaaattgtcgaccagatcagcacattgacgctgctcgagactgccgacctggtgtctagcttgaaggtgggtttgacaatctacacatattcaatggatttccaaacagaacatgcggacattccatatatgcgtctatctacatcgtcactctactcaattgaagtatttatccgaaccattgctaatcaaaacgcctgcacagacccgcctgaacatccccgaccttcccgttggcggcttcgccatggctgctggtggtggccccggtgcggccgctcctgctgccgaggaggaggaggctgctcccgctgctgccgagaagacactgttcaacctgaagctcgagtcgttcgagcctacctccaagcccaaggtcatcaaggagatcaagaccatgctcggcctgtcgctggtggacagcaagaagttcgtcgaggccgtgcccaaggtcctgaaggagtctgtgcctaaggaagaggcggagaagctcattgagacgttcaaggcgctcggtgccaaggcgactatggagtaaaagctgtgttattatttaggtacggggagggggtagattgagaagagagtcgggggaagatgttgtccatttggtcttttcctctgttcttcttctctttgattcttgcttttgagagatcttgttgagcatttattgtgtttggcctggcagatcaaggcaaaatgtacattatacgcattgtgttctgggaccgtctggtacagagggctcatttggttaattgatgcatttagcatatcaatgctattctatcgcttttaaaataagtaaatatcttctttaaatactacattgccgtatagtaaagttggtagatctaaatgtcaactgttcggagtagcttcgcggtgaagttcccgatccccagagcttcggagaaaaaaaacttccccctcacccaaccaacccccacgatctgcctctgcgctcttttcaatggccagaccattgattttcccattacgatggcgtcaattacatcaagctctctgtccaaaagcccacgcgttgcgccacaacggcctgcaagcttgcaccgctcgagctgtcaccaatagcaacccaaccgcatcgaaacgacccttccacactactcaatcacggtcagctattaggccttctcgccgatcaccatctgttcgaaaacaagagaggggggcgggagcggtacccgaggatgtgttagaaggcccaaatggattgacgctagaccgtgacgggttttggaaccattattgtgttgcgcatgttgaaccaacattggctgagtttaagaaatccacgcgtcacctttatgagacttacggcttcgtcttaccgccggatgttaacatcgcgacgtttgggtctgtaggtgaacagttaatcaggctgtcgcactcgcggtacccttccgcaagtcttatacggagtatctcaataggtgagtttcaatttcaattgagtgtatagcggaaggctatggattgggtgatttagactaactctgcacttcattatagatgtcgacgctgtttatcgaatcgcgttcgctctgagacccctttccaaaggccgctacatctacgaatgggcgttgaccggctgcgcaaaagcacattcgcgccgagcccttgtggatttggtgaaccagtacatcagcctcgaaggcgtggatatttaccgaaacaccgagcccatggtgcagatcaaagacttggctctcaaagatgaattccctcaagcgatcatgctatatgccaaactgctcatctggcgtggcgagaacggacaagccgcccggctcctagagcagaagattctgccatacctgcaacccgttagcaaacgccctcccctttgggaggatatacggttagtggacgacttcgaatcgccctggcggatgtacgctattgctattgagaaggaacagggtctacagggcatcctgaatgccacgcgacgcgccgccttggagttctacgacccgcttgccatgactgactatgccatctccgtgttggaaacggatgaacctcacagatacgaggtgtacgaatcgtacatggccgccgctgcattggggcaacagcctctagcctgcttttaccttgccaatttctattaccgcatctcccaaggcgaatttacaaccgaagcagagagagacgccaagaagagggaggaggcctatgccgcgcgccacgcctggttgagacgtttcgaacccatagaaaagtgggttaatgatttgttcaaccaacccctcgaccgcaagtcataccgcatgatggcgatggattggtacgagcttgcctttgatatgggaaacaatgaggctgggtatattctagccttgctccttcgcgaggatggcgagatggagaaaagccgtgaggtgtacaaccttactgctcgaaggggtctccctacctcgttaccggagaaagggctgaaagaaatggaggataagtgggaagaccagacctgcaaccctggtctgcctcctcagctcttgaggcttgcgtaggtgctttagagccgttgtgtttatacctttaatatgtatgctgtacatttttgtccttgtatcccaatatggtatcattgcaatgtttctttctggcgccttttttcggccttgatacctttttcttctatctatcccccgctcccaagcatgcatgtctcatctcgcctatcccatgtaaaaccgacagaagagaaaagcaaaagttcagaactgtcgttatgattgaagaaaagaatcaaacgccgtgtttcatccccgagtccaattttccttttcctcgtgccaaacccgagacaaagccattcacagactccagactgacaacccatatattcgaaggatgataatatcaacacagcagaagaagacaaaaggaagaccccccccccaaaattgacaagagccaccactcacaaatcaaaatcaccgcctcttcttccccttccccttcccatgacccctcgtcttcaactccacaaacccaagttccttcaaaccctccgcaagaatcgacgaatccctcatcccggggaaatccttcgcaggatacacccggaacggatcagaccacgcctgcgcaagaatcggcatcgactgtcccgtatcctccacagagccccaattcatcaatcgaaactgcagcctgtataggcccgccgagcggatcgagagatccgcgaagatgaaaaaggtggctggttggtggaggcgcgaagcggcgtggttgtaaacgtggtgaggggggttggagatatgaggatcggatatggaggatgggtgtgcgggagcggagttggggtctgggtcggcgtcgacgtagaagggggacataaaggctttgcccgatagtaatggggttgagaagttgtcgtctgtgcgggcgacgccgtctgtttctctttctctttctcgttctctttcgtgttctcgttctcgttctctatcgcggtttccgtcccggtcttgatctcgctcctgatcgcgctcgcgtgaatgtgcttctgttggttcggcatatggcaaagaaggtgagacggggaatagtagacagcctactgtgaagcgggggtcttggaggagatcccggtcttcttgtgagttggagtcgaagtcggtcaggaggatctgcacgattgggggtgggtcaactgggcggcggtctctgtcgcctgcgccgcaggctcgtgcggcgatgggttgctgtcggatgtggagatggtatcgggattgggtggatggtcgtctgggtggtggagggggtgatggtgattgtggctccggttcagggtggaggagcttgtcgaagccgtgtggcattctgtagttcgcgtttcgggactgtggtttcgggtcttggtgaatgctgggtagtataggattgaatgcgtgggtggctgcgcttttatctgaccagacggggctgggcatggccgtagaactgctgctgtgtctatataaaagtccgttgtcagaatgtggttcttgttagaatgtctcctctgcattgtgtaacctgtcacagatgtgacatgagacggaggattgtgttcgaattctccaagccgaagacatcgcatcaggacggagcactgacagatagaggcggttcaatcgacagaaacgaaaagagagggactttactgggactccacgtcgtatgtccagctccggtgactctcatagtcacgagcatggcccgaagttgggtacgttctctcatcgtacgggttgtagtaaccgcgggcatcagagcttcccggatattggtgatagggtcggagagggagcgtttggggcgtagattgtgtgttcatgtaggcattgtcggacgaaagcatatatcggggatctgtgcttctttcaggaacaaccaaggcaggtagccttggaccaagaggtgccccgtgcatagggcgcccatagctcgtgctctggggtatgatctgtcgaggctcatgtgggtaaggatatggcatgggtgtcgggccgcggtgttgtgtgcggggacctgagtcgatgtatggccgttcaggtgtggaattcccacattgctgtggcggtggcctcgccatatattgtttgggggacttgcgcaagtcccaataggtggtccttgtgttataatttagatattgccgtattggggttggtttcagacgaggtaggttgcagacgaggcattgaatgaaacgcacaaagcggtcagataatcacgatcagaacagagtcaatgtcccagatagaattatatgtcttgatgggaaagagaaaaacatatccggtcaatgaaggcatctgatgctccacatgtaaacgcaggcggttaacagcgacgcctcatgacactagctcggtatgatcttttcttcttcttcttcttctttttttttttttcgccctgtcgaattggctctatacttccctcggggggattcgttggccgattttccttagggatcggaaaaaaaaaagaaaaaaaaaagaaacgtccacagtaaattttaatcacccctgtccagtttccccgagctatccaaccatgtgatggctggaatatgacaggggagtgggaatggtgaaggtcacagtattgaataatgtccttgtcttagtcgaaacacttcgataccctacgattggcgtatccaccggtaatgagaaagggaagagccgggggaacggggaacgggccgagtgggttttgccacgagaaggggagaccagaactacacaagtgggcgtggacatgggtgtgtgggctgtgcctccatggaaatggtgcgtgagctgaatgaaggcagaaaatggtctccgatctctcgaaagacggtcaggcaatcgaatataagtggaagctgttttgtattgtggaactcgcatgtacaaccgggaagcttttcttgggaagggtgctcttgaagtatctcgtgttggcgtacggagtgcagccccggtctcgacccatcggcatagtgcgaacggggcaagaaaaaatggacaaagaccttgtcgaattgtggctttttgcggaccggtctacggggttgtgggccgcacacgaccagaggggttatgtgttttggctttcagaatgtgtgaacagcactccgtacgaagtgtgcggattgtacggtgtaactggcgttttagcgaaaaactcagatgtccgctttgtagagtacagtacagcaaatttgccgattgctgaccgacaagcctccggcgagctgggaaccgactcttcaaatcccaagtgactggatctggaagctgccgtgaggcgtggtgattggcgttcaaaccgttgcttggcaatccttcagaaaaggatctgccttcccccccaacaatggggaatttggaagtgttcactggaactcaccgtcgtggtgggatgatcttggtagggacacgaggtagtcctagggcaatatagtttcgagggtggcaaggagtaagcctttcggagggaaaccgtataacctggcaagttcatcagctttcctgagattcagagtcaattgacattccaggacgctcttaccattgcaacccctgctcgtgggtctctgagtggactttgacagcaattccaattagaaatggccaatggtatcttgccgttcgatcgatcggcgtgcaattttagcgaagacgaacgaactagtactaagattagacgggttcagattggtccaagcgcttgagacaattttattgtcggatccgagaagtgtgcctcttgtcatatgtggcacgttgctaatgctggggtgctgggggccatttttgaagattttgcagcccaatgctggaaggccaacgtggattggaagtccttgagttgcagatgcaggtcgagtttcgtcaagggtatttgagttctaaccttgtcggcagttctagggactcgcgtcgactttggactagacctcactccagttcttggtgcatgagaatcgaatgtcttatgacgtacggagtactccgtactccgtaggactgaaaacccatgcaagtcaaagtttttgggtatgcaaccccacgtagcagtgtggctgcgttgcctcttcgttgtagttccctagaagacgcccgctgcgtgctgcaggagtgcaagaatcggggtctccatatgtccatcaccacaaactggccggaataggaagagatattcggaaaaacataccactcatagccgggaatatccaagactacgaggggcttcgataccaataccaaatgggtggcgtccccccatccttaccgacggtcttgatattgcacatggcgtgggaggcttggctccatatttgtgtggaagacgcatctcagtgcgtgtcactggtagactgataacatttccgcggacacccaagacaggccaagttgggattcggaatcctagtcagctgccgatcaaaactgttgattggcagtaggttcatgagctgggttcactggattttagatgaaagagcaaaatataaagctttcgttatatgggagtcatattggagatggaagagtagccgaaaaggatatgcctacaaagcaacacatctagattctgccaaagcatatcaccgctcagtcatatcaatagtccatgattcatctcattccagcaacttaatgattttatggatatttcgcacgggagaaaactcaatactctaaatctgcacttggatctacatccagatagtaaggacccgagcaattccgagcgtgaaggcgaccaagtattcgctcgctacgattgcctgggagttcgagatgcatcaaggcaccaaaagggccatctgagggtgctggtccacagtcaatgaccccgttgctctgcccaacataaagcccgaggagttccccgtaatgacggtcccaaaccacgatgtagcctgacggttgccatggttcgtctggaccatgccgcatatccatgcagccaagttgcatcaaatgtaagttgtcgatccccatctgaggaactccgtgaatgatgaaacgagcccgaataaggcctagggtagatggggtcataggctcagacaaatcacgcagcgccggaatttgggagttagaaaattcaatcggtgattgttctggtacccatcggagctcgagggattcaagcttggaacgaacttcatcaagctgtgctacattgcaatcaagacgagtgatgatcgtttggggctgtccgccgtggtcattcaacagatctgcgaccctgcccagtgcagccggagacttggagcagccatgagccataagttctgcatacaactgtcctccatggttggagtcaacggatttgttatctattttcggtaaaagttgatcatcaaatgcttcccagattgattctgaggggtccaaggccgtactgaaatgcctttggctttcagggctccattgaacatccgtccttcgatccatgtcctcaaggcaaacctcaagtagttcaagatagtcttctcccctcactaggtcaggcagtgcctcgcccacaatagggtcactaaggaggaatccaacattggaaaacttcgcaatgaatggcaggttatcaccacaatgttgagagatatcttccaaccatttcactcctatttcggactgaacatttcggactagagacagcactacctcataggcagcaatgcagctttgagagtttttaggctgaatgttcttcaagaaatgagaccaacatgtgtgaagtatctcatcactcccaagcctagcaagtagacagatataatactgggcttcgttttcataattgaatcggtcgccaatttgatcagtaggttgcgtccagaacaaggtatcatgcaacctgtgtttttgtgccacgagtcctccttcacctgtgatctcagcaaggatgggattgggatcataggaggggtcctcaaaagccttgcagtcgagtgcttctgaacaaattcggattatctgcagacttgttcggagatttagggctcgaatgcccatgtggtgatggttatacaagaagtgcctcaaatctgaaggcgaaagagcataaaatgcaaagtacagcgctatagcgtacatcctgggatgaacaggaagctggagacgtttcagccttgcaaacaggtcatgcatcaccgtcaggatctctgctaatgtgttgttccgttgacagcgtcgcaaaacgtcacgtaattgggagcaattacgagactgcaatatctctgctccatgtctgtcgttgacgtatctctcaattagactccgtaaggaagcgacatcggccatttcgctactgggatcccacaacaactctcggttccgcgatgtaagccatttgagggaggtccacaacggcggaggtggagtgttgaacttccactcggtagcaaattgtccatggaggtatccagataagacctcgttagtattcgagtcatgaattggctcagttgaatccgtcagggcgaaccgaagcagttcagatggtgatgggtcacggggtcgtttaatggttgcgggatggaggctgcgcaccaattgccgcgagagagtattcccagtgctaagctgtagtcttggttgcagcagcagcaaccgagtaggcggtcctcccatgtcgactggattgaagctgatctccaggagaagatgtggagaagataaaggtccgataaggactgtacccaagtctggggtcttgcccagcagatcaagggcggcgtggaaggcggtgtgggggccgcattcgcgcttttatttcgtcaaccagctaactgccattccttatcaacctagctacgaacgaaacacttaccgatttctatccatagctgctgttgatctattgatcaacccaagggaattatggttcgaaccaggaatgcggataaatccgcgaaggacgaggcgagccaagaacagcccattgaccaaccgactgagaacacgagcgaatcgcctgtcgcatcttccgaaaagaaagtcgaaactcaaccagatgacacaaaggatgacggtgcatcaaaagcgcgtgagagaatgaataggttcaaagccttgcaggctcgagctgtatgtcgtcctcaaaaatggcttgcgcggatcaataggcttggccagcccaacccctccacataactgaataactgacacaacatatagaaatctgcaacggagcgcaacttaaaagagactgcagccgagtcccaacgtctgactaccgacccagccctgctaaatacgttgtcccgcaagcatgcattcgcctcccacaacctcctcaaagcggatacggaagccgcaggagaagattttgaacgcaagcgggcatgggactggacagtggatgaatcggagaagtgggatagacgcatggagaagaagcagcgtcaccgagataacgtggctttccaggactacactcaagatgcccggaagatttacaagagacagttgagagagatggcgccgaatctggagtcctacgagaaagaaaagcttgctgcgatcgagagagccgcagccaacggcgatctagagattgtggagaccgaggacggtgaaatgattgcaattgataagaacggtagcttctattccactgcggactcgactggctttacggagagcaaaccagatcgggctgctgttgacagactggtcaacgatatccagaaggcagaggaggtgcgcctgaagaaacgcaaggagcgccgtggtggtgatgatgacgcggatgtgacatacatcaacgagaagaacaggcagttcaaccagaaactcgctcgtttctacaacaaggtcagttttccgctgctgtctttatgtgatccttttactaacactttttattagtacaccaccgaaattcgggacagcttcgaacgtggcaccatgatttaagctgaatgtgaaattcattgcaatattttacattagtggacgttccgagctatacagctgtgcctgaataggcaccaatcaaccagcagagattccacgcgctttcccctctgcccaaaaaaatttgttttacaaacatacaggtcacttgatcagccaacagacctaaagcatcgtctttcgccaggcttttgttgcaagtgcctcaatctgttttgttccgactgcacccttggtggactcatcctccaatgcctcgacaaccgcttcgcccacaacatcggctttgaggggcttttcggccatagttccgaggaacccaagcttattcccgaggaaggtattgaactctgaggcaacaaaaccacccattgcaattggcagcgtgaacttccgactcgagtcgtacatgaagcccgggcgtatgaagatgctccgtaggtccgggagggtggatgtgatagttgcctccgcttctcttttagtactgatgtacctggccggcagaatcggtgccccggccgctgcagatatgtaaacgaaggtcgggacatgctcattggtggactcctgggctagtgcaattgctaaatcacacatgtgtcagctttcaaaacagactttagaactcttgtccgcacctgaatctcggttcatcagctcataggtcagctgcccatctttctcttttggctccaaagcctcgccctcttgtcttgttagagggttttggcttccaagcttagatgtactaaaagctcgttgaaggccactgagaattggttctctcccttgcacaacgcccttgtagtcggcttctaatagaatgcccattgagtggacaacagcagaggcgccatgtaaatgtggcttgtagctctctggtttgagaatatcggccttggcccattccacggagcctgcccagctaggccgttcacgagaatcagtgactgcctcccaccggggctcaccagatcgactagacaaagatcagtttgtgctcttccatagatccatacataggcgagaaagctaaccgaccttaatgatgtgactgtccatccccttgctgttgcagctttacagattctggatcctggaatagctagtcagtaaatgatattgatatttctgcactgaatgcaaatcacaaacccaaaaagccgcttcctcctgcgacaactagtcttttggtcggcatgctgtagctttgggatagctccggagaatgatatcactaaggaatcggaacaatagtccgggctatttaggttcacaattgagattctagagctgagttgaggaagtgaatatcatgctcttcaataagcgaaatagttcaattgttcaaggtaattgtctcttcaccaggacttttgaagttagcgttcggcatcattcgccttcttgtcgggccacttgagccccgacggattatccttcttccgtttcgcccttgctctggacaatccgtgttcatcggttctacaatctaacatcaacgtgcaagatggtatctgcaacaggaaacaagcgtgtcagggtaagtttcatgccccgggaaatactaaacatgaactaacacgctcgcagggcgtctcagccttccgaccatttggtatgttccgcaaagagcgcattatcgccaaccgccgcaagctaataaacacagtatttggcagtgtagcgacccccttcgatcccaataataagccctcagactgtcctccagaccacacccacagttggacgatattcgtcaagggagtcaacggcgaggacatttcctactggctaaagaaagtccaattcaagctgcatgagacatacgcccaaaatgtccgcgtggtcgagcagcagcccttcgaagtcacagaaactggctggggtgaatttgaaatccagatcaagctgtactttgtgcctgagtcgaatgagaagccgcagaccctgtggcacagcctgaagctacacccttacggccctgatgcggagggaatgaaagagcgtcgggaggatgtaatcagccagaactacgaagagatcatcttcaacgagcccgttgagccgttctacgagatcctcactggaggcttcgctggtggtcaggctggcaagagcaagggaaagaataccaagcagattgggcagaggacggcggatattccgatgagcgatacgcccgggaacccatacagtcggacgaccgagaggaaagagcttgatcgcatggccgaagccactcaagcagttgagcagatgatcaaggaagagaaggagcgtttgatcgagagggagaagtatctggccgagctgcgagagagtgagggtgtgcccgccaacacgaagaagcggtgatcgttccagacgctcttctaagccgagaacctaggccattgctgcagtgtgataggcttttgagcaccccgtcaggatgtgcctgaccaacaagcatcatcacccttgtccaaacgctcctcagtgctgggaccctcctgagaggctctactgccccccggcagtcgaagtttatgtcattacacctctgtgaatcgccttgccacaagatccagcctctctgtttccaccgagttcaccacgatgattgcattatgccagatacgaccaacaggcccgaatatctgcgtcatcgcaggtttgtgcctgggactcgcatggggccctttcctcgttatctgccagatgggggcggcgatcttgggaagcaccagggattctatccaaaccatattcataccaagtttgcaacaagattgactccggaatctgccacttacatggggaaggggaaaccctacgaggatacggtcatatcgccgtggatgtacctccggatctcgggatgtatcctactctagatcgtgatgcgattctttgtttaggaaggccatattgaaccatagtactggtggcaaccaatgtcaatttacaatacggaaagacaaatctatatcacaatatgttcgttcaatcatcgcacgtccatctgaacacctagcacttagcatcttgaactgtgtctctggtctttttcaggaagggtattaaatccgtgccaccagtcccagcaagcttagtcttcgtgcctgcttccttcgcgtgagagctagccgtggctagattcattctaccttttccttgttcagttggattaggctgtctcgatgccatgacaatgtatcgagtgaccatctggatgtgtgtatcgcgaaaagccttcagctcgttcacagctgcgttatacgcatccttaggctgttgaaccggcgactccagtataaacggacgaacactagctcgagcggatagttcctcaaggaagcgcctatgcggaccaggcatatagtctcgcatttgctgtcgttggtgttaatacttggtgaaacatgtctgagacagaggcactggaaactggtatcccgtgatgttcttacctgaataaaactcggaccaccagtctgcttcccatccgtcgcagagtgcttaataccaaagaaaatatcaagtgcttggatcagcgagctctgtgcattacttccaccatttaactggagccaattctctggtctttccaccctatcactatcaccaatgtcatagtacacacccctgggcagaccagcatgacccatattcttgctgccagccaggaacggccgaagctggtggaagaagacagccggattgttgtgctcgtacattctttttagagtcaatgtcaggtcgcataaaccatcggcaaacctgtacaagaaggcagtgagaaggtctatatcattggcagcaactgccttagaagcgtccctcatcagcgagatgagtttgatgcccttggcttcaacggcgacggagattaccatgaaccattcctcgtccttcgtgccggtgaacgaggtctgaacatggagattgtccgggtctgtgatgtctgcttctgggtgggaaggtatgaagttccataatgtgaggccggcgtaagtggcgcaggcgggaagttcgaggtgtgctgatatttcaaggaagggttttgagattgaggggggaagcctctgttgtctggatgttaatgggatttctttgtttgaacggaaaggaaccttggaaagggccccggggcccggggtgatgggcgcttacgtcttttggggtctctcctccccagatataggcatgagtgaaatatcccataataacacatgctcgtcgccattctggttctgtttgaagattctcagtcgtgcatacgggcatattgtcgattctctcgcggatttggtttgtttggatgaggttcgggagttggctggctatatcctcccaaatctcgtaataagggtttgagattctggccagcggaaggccatctgggaggaagccctgctcagcataaccttcgaagagatcattgagaacagcatctgttgattgcaacattgtggattaattggtgtaggaggttcccggtcgagagggagaacacggcagacgtggtataaacaaagacaaaggggaacgactgccttttatgtttatagtgcgaggtatagtcttagtactaggatggtctcaatattgaaatatcttcctgcatcggcttgcctcggggtcatttactcaaaatacctatacagtccggaagctatccggatctatatccgtcttccgcctcttgatgcgatacatcaaccgtctcttcgttctacccactttgttcagcgagggatatagaaaagggtttgagacatagatcaagtctcctgtcaaataagtatacccaaaacaggaaataactcctttttgagtttgaggatgtgatcaaggcctcgaagactcggggatggtagccaatccaacaaagaatgttgggttctttgcttagctgacctgcataggaggcaaaccacctgcaaatattgatgcattatgatgcatgtaatgcatagtccatagtcaatagcctacctattatacctattctgctatttagtagaatccatggatggtcagtaaattaagtctaatatgatgtaacgataggcttacctaggtatacggatgtctacatatgtagttatgtggtgagaagacggatcggggaagacggaagcggaacaacatccgggttgacgacgacaagttgcagctgtgtctccctcgtctccgattcggcaatgggggaattataaaaatcaatagcatttccgttttttctcgttcccctcattcatggttataactcaaattctcctgtgacttgctacactctatattccatttatattccatttccacagcatttatagatatgacgggtaccaaagcttctaagccagtcttccctgcagaggcagcatcacaagattatgccgcctctctggatgcagcggatcctctgcgtgaattccgcgaccaatttattatcccctccaaggctaacctcgccacaaagaagttggcaaagccaggtgagaaactatatcccagcggggaacaccaaatatagtttgattattgctaacaacgttatgtaggtctctcgtcagagccaagcacgtacttttgcggtaactcattgggcatccagcccaaggccgtgtcaaagtacatggaggctcagttggatacttggtcgtccatcggtgtctgtggacacttcaccgatcttgaagattcaccattgaaacaatggcagctactgtctgaacaggccgctgcttcaatgtcccgcattgttggggccgcgcctgaggaggtcgcagccatgggaacgttgactatgaatctccacctgttgcttgcaagcttctacaagccgacggagaccaagcggaagattctcatggattggaaggcattccccagtgatcatgtgagtgacaaactacaatgagaatggtcctctcagggctaatattgtgataacccgctgtacaaattacccatcactaacatgctcatagtatgcaatcgaatcacacattgcctggcacgacctagattcaaaggagaatatgattctcattggcccagatgagggacaatacgaaatctcaacagagaaaatcctgtcctatatcgacgagcatgctgaaactgcagcgctgcttcttctgcccggtatccaatactacaccggacagctatttgacatccccacaatcaccaagtatgcccaatcaaagaatctcgttgttggatgggatttggcacacgcatatggaaatgtggagctgaagatgcacgactggaacgtcgactttgcagcttggtgcacgtacaagtacggcaatgccgggcccggcgcaatgggtggtcttttcgtgcacgagagacatggtcaagttgactatagcgccggaccagatgctccccagttccgtcaccgcttgacaggatggtatggtggtgatcggtcggtgagatttaagatggacaacagttagtttcttcctatttgtctctcgcaatgcgtcttctagcatatgctgaccaaatcaacagagttcaagcctattcctggagctggaggcttccaggtctccaacccctcagtcattgatctgacctgtctttgtgcggctttgtcagtcttcgatcagacctccatggccgacttgcgccaaaagtcactgaagttgacggcgtacctggagttcctgcttctgaaggataccgacgagaagactcgtctgtatgatattatcactccatcagatcccaatgcccgcggtgctcaactgagtgttttgctcaagcctggcttgctgcacaaggtatccgaacgcctacagaatgcgggtatcatctgtgacaagcgggagccgggcgttgtccgtgtggcgccagtgccgttgtacaacacattctctgaagtgttcaactttgtcagtgaattcaaggccgctctggcctctgagtagttggtaaatgattttatgacgaatgtggataaatgtcgagtatgataacgcaatgcacactataaatagtacgccctggaccttccgtaactattccacctcaaaattgaagaccagatagatctacatgacagttgaagcctgctggtgcaagcccttagaaattcccaacactttcccagttatcaccactgcgcaagaactcttgcccctgagaaaagaaattggtagcaagaatagagaactcatcattagacattgtcaaatgttgcggcgagagcaaagagcttgctgggtagtcctggctaggaaaggcggtattggcactgtacgattgagaccgaagatttggtgtatcttgttcctggacagtcaaccggaacggcggaggcaaaggagacgtctgagatacctctgcgcctgcagaagacgaaccggcatatatcgactctccgaatagtcgccgagcagagtctgtatcgctgttggaggagtattcgaggatttcccagaatcgggacaggtcgattaggaggctttggttttgcgcgcctgggtctgactggtaggttgcggagactgcgtcttctagtctctgcaatctatgagcctgttgataccgaatgaagtgttagattgttgatttaaccccacaggcaatccgaggagatgggggtccataccagtcgagccatgtgcggccacctttctcctatgccttgcacaaacttgacacacttggcgaatctttcgcgcttatgttctctgatagtcaaatcatccgtgaagctgagttgcagctcgattgtagcgacaacggcggcgctgtaacctagtagcggatctgatactagaaaagccttttcctcaaagcagttgataaagtggatgatccaggttgtatgcgaggagatcaggtccgaggtgtgctgtaaaaagatctctgggatagtactgcggaaattccgaagactgagcgagagaagcagcggatgattgagtagacacaggctggtatgatacatgaattgattcagaaaccacgggccccagtattcacgatgtgcctgcaattcctcgagagagcgttcaccgaggttggctggcttgaaccgatgaagatacggcatgcgagtctcgaggtccatttgtaaagcaagaattttcgagtattcggaatgaggagaccatggtgggacattgcttgggcgtccgtgaaggcgcacgtatcgcgccgtccttgcgaacacttcgctcagcattaccacataagcaatgattccttcgtcttgcatgtcacttcgccggatttcgacggttgatggccccggagagagaaagcgtgctggtcgtgctgggctttggggatatggagggcctccggcttggggtatgtccaggattggaaagtcgccgccatgtagtcgtttgagaagacatatactccagaagcagcgtctgcgttcttcgcggactatagtgctggttgatgagcggggctcttgtccgagattggcacattgtgcaaggttcattgccaagctgctgtggatgctggacctatgtgtattaccgtctggtagatattgttagctcgagtctagatgttggaaagatgttggaaacgctgggtccgtactggtgaaatcaaccaagctcaaaatacagagactttgaagggtcgaaagctccactggcccttctgagactcttttcataacgaggccccgagcaacctcagcatagccatttatcaggctagtggaatcggccctgctatggtaaccgtatgagaaacgaaatgcgagtgccaatatagcaaaaaggagctctgtttcacgtgtttgtagactggagagaaagctatccctgtagaaaagaggcaaaggctgagagtcacagtatagcagatatagctctgcaacgggaataatctcctcccacggtggcaggggagtagatgaactcggcattgacaatgccacagatggaacaagagactcggtgggtatttgcggctcactcctcgcgctgcagcatgtttctaagagtaagtgattgctcaaatagggatcatgtacgggttcttacccaagtacatccagaacctttcccactttgctttcaaggcttcgcaacctatcttcctgtggtgggatcagtttccgaagaaggactcttcgagcttgcattgagagtgaaagatacttaccagaacatgggatgtcccagggtctgaatcgctgagccttggattcaactcgggaagtggccgacgcctttcatcagcgtatagacattgttgccgtagcctggcacacagagaacagaccggctgctctcccgggcatttagcttttttacgcctgaggagttggttaatggctatctctttgtacaatccgatcggcataatacctgcaaggctcacaagcctgacgaacccgcttggcgggtctctctgaatagttgaagctctcgtcttccattgttatattcgtaatattcaatgctctcaatgaacacagtcatcataggagtatgaatttgtatttttggaccccaattgacagattatattgagataggggtatacgtagtgcatgcccttgcttcaagggatacacagattggaacgagcaaagccgttgtacattttggcgtagagacggaagtaaagccgtgaaattggccagtggaccgggtccgatatgaaatggctgagtaatcacttgtgaagtccacgggtccaccgaccgggcgttggactcatgaacgcagcccgcggggcgcctggaccccgagccttaggattctgttccgcgatgcccatagacctcttgggcacgttcacgtcaagcctcgtccatcattggctctccttgccgtcagttgtttccatatatctctgaacggattttattgaataccctgtgttcctaggcatgtgagatacatacatgtatgtatcttttagtctcatcttgaaattctatgacctcaattcccaagaccgatacagttatacgagctctagatgtgcaaatgaaggcactcatttgaaactgaaactacgaaccttcccgaagctgtgctgagtgtcgtgactgctatatctgagcctttcgtagttcctcaagcttgtcataagagtatcaaacaatcggacgtacgcactacatatatggctacgacagacggtataatacaaggttctttggaagaggatcgtccgtctcctgtaagtgcctccttggaatagcccaggcaagtcatgagtcacccatgtcgaccttcgccatatacctatctccccactgccgtgtacaggtataggcggagaatactgtgcttaatgtgtggacagttattaccgccacttggatgtctagcaggactgataaaggccaagatagctcggcttccacttgttgcgggtcatagcacaaccatctccattctatcaaaaacagtaccacccaacttggggcgaggggtctgaacgactcccgttccgtgacatcagggaaacgatatatggcagcatctcttggattggcgctttaattgatcatatgtacagctccaaatctgcgtggctgccaacccatctaacccctccctggagtagaagtacaccatacaaaaaaacaactgatgcctcagctgaataaccaacggaactggaaatggcatcatttatcattgccagactaagccttgagacctacaatttagatccaagtcttgtggccctgtaaggaaatcagcatttgaacgtatcaaatcggttactcgtgcttcttgtcggaagatgagaggtgggggttgggtaaaactcacgagaaccatgcggcacatggcataggtggtagctattgtcgattagttttctatcctcaaccggatctcatatcggcagacgggtttactcaccagcaccgaggccgtagaccgagatgaggtaggggtacatgaggtagctggagcgggaggtctgcgggacaatcccaatgtcagtctcttgttctttgcgaagctcaattgagggtatatgtgccccttccggaggtactgaccttccaccattggcgcttgccatcgtggttctggaagagacgctggtagtagggcacacggttctcacggaacacgaagctaaacagagtcaatcagtcagtataatttgcaattagatggcgggatagcagggcccgcagccgcgtcaatcgcaattggactccgaagatcgcgggaggaaattcgatggtcgcactctcaagatcgggtttgcgcgcgggggggttatgcagcaattcgaagggaggacatacccagccatgcgggagctagtagcacggaacattttcgcggttggaagcgaagaaagagcggggatgtgaggtacgacgtgggcaagatggggatgtgaagttgatcccggaatgagctggatatcgtgtcacgtgttgagcatcacctgatcgaatcagacgttgcatctggtcatcatcccaaaagggaaaagcgccagaaaagtgcccagacgcgtatcaactttggaatactcggcaacgaatcttttggattgacgtcaggagcttgaagaaggatgtttggcgtcgagaatttgctttcccgaccttccttccttaaccactcatgcgcccggcgcttctgcgactgttgaagaggccgtccgccgtctcgattcttgacacccttacagccacaccgatcggaattgagcaattggagtccaggtacaggtgtctacggtgtcattcgggcagcgccaaacaagaaccactcgaggaacccgacaataggccgacccggcatcagcttgagaattcatgccgagcgaaacggccattcagctttcccatctacgacattgaggcctcgaacgaaccaaatacttttgcgcccacgcctcctgtggagagccgaacgcataataacacgacacgatgccctattaaacttctatctctccgaccggacaagcttgaattcgaatcggacgtcggacacctcaacaacattggaacgcgattagtggacaatgcggagcatcgaaataatctcgatctgtgggaggagcttcttcgacaccgtcagcgccattacggcgacaatggcacactagaaatatgggaagggttgagggtccgagtggatggtgtacggcttccggttgcaggagagcaagcggacttcttttggcagaactttgtggacatgggactgagaagagaaatttttctcaaggaggttattgactatgctgtcattctacgggagcaacaaggcaacggatggccacagctgtatgagcgtgtggttggtggatttcttgaccaaggcttgacgaaacgtgcggtcgaatggcacaagaagcttcaaagttctcatttagccagcgcaaacgatgtgctgaaaattcttccctcggcgatccgttcttcgtctcttccggctggcacggaatttgcgacttcggctgatctccagcggtcgtccttgtcgccgggattgcaggcattccaaaccatatgctccgcgacacccgaccataacttttacggccctgtcattgcgacgctcgtgcagcagggccacggcgaggcggcgatctcaatgcatcatttccttgctcgacgtcaggatcacccacagagccccgacgagatacaaccattgctggaatatgttgagagattcgggctgcggaaagagttcaatcagctccgtggctatgtcaaaaaacggtttgataccgaagcttcgattgaccaacctggtccaatagatgcagccccgaaatccgaggagaaggggtcgcaagacgaaaaacccttcaaagacgacattggtgctaagctgtttgctactcgcgctctcaatttcgatatgatcgttggtggcctgaagatgctcggtgtatcagagatcggtcaccggacgttgcgcgaactagccacgagagctcacggcaaccaagatctcctggacaagcttaaaatacttaagcagtccggcatttctacaggcagcactgtattctcgcgcttgatccaaaaacttgcctcccaaaaccgcgacattcttctctccgacttcctccgcagcgatcagcatcctgatattctcgaagacaagcgtatgcaggagtccatgttggtgtcttactacatggcccgggattggcgactgtataatatgactctagcggtgttgacggaactatactcgggcgcaccagatctctacgacatccactttcgaaagcatattgcggcctgggaattgaacgcggcgtctaaggtcgccgatgagctagccctccgtgggcggacgttgggcgaagacagcgtggatttcttggccgagcagattctcacccctcggcgaatgaatcaccgcccgccgccgggccaacgcctgtccgccgtggacgaagtgatgttcatcttcaagattctaaagcgtgtggttcccgccggagggtatgttagtgctgcattctgggttgagatgctcaagcgtcttggcatggcagaggcgtgggcagactgggataaactccgagattgctgccagtggctcgttcgacaatacgcggaaagccgtgaccaaaagcctgggctgaattttccacccgcgaaaccgtcccttgatcccaccaagcaggccaacggtcgcgatcggcggatgctcgatctggtctttaccccacaaatgcaagcggccatcgtctcctggggcttcatgttccgagtattggacaccaccgcatctaaatttaccgtcgccccacctaacccccaaacggatgaaagactcattccatgggtgcgggggctgattctacttcgagagctggaacaatccggtcttcgtcttgacaagcgattgatctcacaggcagttcgccaccggctggccatgctttacagccaccatgttttgtcagcgcggcgcatgaaccgcatgttgcggcggcggaacccgtattccctacagcaagtgttgaacgatgtgttccaggcctggggcgatccatctctctttgatgggatggaacagaacttggaacagctggtgaatccgccacgagcgagcagaacgaagcgacgtgctccaggtatacgtttgtcgcttaaaggactatgatacctgcgtccacatgtatattagcagatgtgtaaataattgattataatacccatattattcgagaatcgtacgcgtataggaacaataaaattggatcataatagttatgcctaagatcactgggctatgtcacaaatagaagaggtcgattggtgtaaatggcccaatggcagtgcaattgtcgatccaccgatctaagaatagttgagagggcaacgcggccttgtcaacattctgtttatttgactccttttcttcttcttttccttttatattcgattcaaattataccgtttatactgttacatctcatacatcatttgtgtacagttatgcgggtattcaacttcctggcactgttgcctgttgtccttgcgaaccctttgacccaaacaaagcgtacgacagcgtgcaacaactctcctgatctttgctccaagtcctatggagaaattactcatctcggcgcccatgacagtccctttgtgcgtgacggtgatagtggcaactcgatagctgccaaccagtactacgacactccaacgcaactatcagccggcgtccgattagtaacagcccaagttcacaagagcaactcacaatggcgcctatgccattctagctgcgacctgctcgatgcagggttgctgagcgattggttgaaagatatcaagacatggctggatgataatccaaacgagggtgagttagttccgcgaggacagattagaaaggaaattaacactccgaccaaaatagtcgtcactatccttctagtcaactccgacggcgccacagcctccgaactcaacaccgaattcaccacagccaagatcaccgactatgcctacgagcccacctccccaggcaccgccccaacaacctggccaaccctccaaagcatgatcgacgacggcaagcgactcgttgtctttgtggcctccctagagaccagcaccagctacccctacctactggacgaatggagctacgtctgggagaacccctacgacgtaacctccgcgtcgaacttcacatgcgagccagaccgaccgtcaacatacaaaggcaacagcgcatccgcactagcagccaacctcctcccgctgatgaaccacttcctgtactcgagcaacctggccatcctggacgtccagtacccgaactccagctacgtggggacgacgaacgccgcgtctggcggaacgggtaacctgggcactgcagcgacaaactgcaagaaggcgtggaatggacgacagccgacgtatatcatggtggacttcttcaaccgcggtccagcgattgataccgtcgataacttgaataatgttaccaatccggttggccgcaagtctgtctcgacttcggatgcgactagtgatgcctcgtcgacgagtaatgtgttcaaggcgctggttgagctggcggaatcggctaggtcaggcacgtcggtgtctatggggaattggatctggactggtgggaactgggggaatcttctcggtggagggatttccttctgagctgagtggtttgacctcggtttctgttgttttgcttttttcttttttttctatttggagcgttttgacgtcgtttcttggatatccttttgagtcctgtgatacctgtgatatgggctgtgcactggctggacagtgcatagcacatgggtataaggtgtttgcatgcaagggcaaggcgttttggattagaaagctgggatgggatagcgggtttcagcatcttcccaaggtcatatagttatagtctctacgaatggaacgattctaagtcaattgtctgtgtttcgatttgcggagttcaactctactttcccaatatctgctgcaccttggccaccttatcctcgaacgattgcactttgtcagtcctaataaagacaattagcaagagagatggattatgcaagataagatgagcaaggagcatagcacagtaaaaagcaaactcacctcgttccaatccgaacatcagtatggatacgaacaactcccttctgatggagaatggtatgcgcctgtccgataacctgatgaacccggtcccaagatccttctacaaaagcagaaaagagtcagtaaatatataaatagcgtacacaggcctgtcagctctcggcgctcggctttcagcgctctcctctctttctctcctgtgatttcagttccagctgcagacagatacgggccacagttggtggagatgagatggaaaagtacaatgtccacataggagctggaactggaactggaattgcggaggtggccaaggtaacactataatactatactactacatagtgtacatatgtagtatgtattatagcatcgagacactccatacgtaccaagggttgtgcctgcggaatgcatgacatacttcaagccgcatgtttcaatcatccgatggacgtcagcgacttggtctgagaccgagggcgaagaggtgcccatctgagattatgttagttagggagaatgtgactccatatttagagaggcttacggggaccagacagaaatcggcgacacagtggtcgggggttgcaatattagacatgttgattaaatggtgagagggtgagatggtgagatggtgagagggtgaagtggcgtaaagaggagatggaggagaagatataaagagacgagatgaggatgtggtcagtgtgacaatagtttatccgcagggacatttacgacatctttactcatttccatatctaggtaggtatttctatttctattctatttctatttctatttctgtttttattccatttacatatttactaaatatctaaccctcaagcctctttacatatcacatctgcacagtctgcatctctgagatatcttgctgaccgccattgcccataaatacggcttcattggcctttttccctctgacctttgggattccccctataacttcatggagttcttccattccatgaccccatgattccatggttgttccttgttccctcgactcttatgacttcccaacgttgatatgatcgacgggggtacggaatacgccactgggttcttatcgattccccacaactaaaccttttgggattttcgaatgtcgggcttctttgtccggcttctccgttctgtctcgaaatcttctttcgggctgtgagctgtgtgttctcttgatttcgcactttcgaagctgattggatatcccagccttggaagattgatccggttaaactcggtttagcccccttgggattcgggtttaagcctcgcactgggatgcatatgcatataatctgaagtggattgtttcaaatacatccctccacctctccacctctccaccttctgatctattcaatctattcccctcttgggtggcggtgataaccgaattgcctactatcattgcctactatcacgtcatggtcatagagatagttttggatctccaccatccttctaacggatgaccaaacccaatctccttgagctcccctcgggagttcagctcgtttacctcgccgagggaggagcaaatgtgatttatcgattcgtcagaaagccagttctcgccaggaaagacccaaagaggccactacctccacctacacacgacacggatcattgcaacctaccaacccaacttaaggggaaattgctccgactccgcaaagaaaccgcagctgacatctcttacacagagattgtccgaaacttcgacactatcatccgaccgctattcaaccccgaagaactagtcgaccaaaccctcgtcagactcccagagggtctcatcgccagctgcaacgagcaactccggactgccgaactaaatggcgcacgcccagaaaaacgccatggcagctatctctgtctacatgagccattcggcctactaatcactgatatgacgacggccggagaccccggcaccaccctggccgagctaaaacccaaatggctcaaccagtcgccatcagcgcccgcgacagcacataggtgtcggacctgtgcgctgagggatatgaaaaaccgcgagtcgcaactcctaggtcgcaaagagcaacggtccttctgtccgctggatctggtgtcggagcagtatgagaatgtgctacgggcgacggggtcgatcaagggctgcaaggatcgatcgcgactggctcgcattttgtaccggaacccgacgctgcagagactgcagtctctgcagaagactgagagggatgttgggctgcacggtccggccgcgcagtctcgggagatgtcccttgcgatgacgttgcgggattgtacaatgttcgttaaggtaagttcatgctgcgagtcagggtctgtcatggtcaaggtcaagatcatgtcgggaaacatcatccagagtcgaatactgacctctccacagatcccccatgacgaaaggtcatctattgagatccgcctcggtgacctcgatctgaagacaggcgccggcgggaaagcgggctactggcgagacctggaaacacgcctgattgatcaaggctggtatcggggaagtaatatcagtcaaaattcgggcgagtgcgctttgcatagcccgcggagaccctcccagtcttatttagcatgagactgtatcaactcgtgtggaatggcattttttggtgatttgaacaaagacaacagatgccttgagtgtgatagtcatggctcgtttgggttgtatagtaattcctttatgacttatttttgggggctttttgggacttcttattgtttttgggttgtttttgggcaagggtggttttctgatattattctttaatgactgcacgtttcgaatatgatttgtaaaaacgtcctcaactgatatcggtgggaaagagtcatctaaagctatgcacaactccataactcctcacgtatggatagtgtgaaatgctggccggctggccggctgctcggatcgcctcaaacaaggacgccgagaacatcctggaattcttgagacgcactctcagtagcagctactttagcatgctggtctgcctctgtattccattctcttggaatacgccagaactgaatgcgcattcctctttcatcccatcgctccatctccccgagtaaacactcccaaaggtccttgtttttgacaggcgcccccgcactcgtcttccagttgttccgcacccatcccttcacccacttcgtcataccctcaacgacgtacgcggaatcagtggcaatgactagacagcgacatccttccccagtccatgctcgaaaccgcatagcggcaatgacagcgcgcagttcagcccgattgcttgtttgcgggtgctctatgcccgtggggccttgcttctcgagaggaaagcttgtgtggccacagatttcagggttctgggtggagtttctgtagacaaagcaacagccggctcttggattggcaccgccgttgtctaagcatgcgccatccgtgtagatcaggaattgggtttcatcgttgcgacgaatgaaccgatacacaggcggcgtggcgttgtgagttttgcggagtgggaaaagcgcctgcggcgtgttgcttgggtttgagaattgaactttgtagggaagacgcgtcccgtgccgactctgggctctccacgagacgtgggcgcaccgataacaacaagaggaggcccatcaatttcgtctgtgtggtcgtcaaggtctgaggcttctgagtcatcatcgtcctcctccattaacacctcatccatatagctgtagtcaacacgaggccgatcaatgtcgtctgtgtgactgccaaggtctgaggcttctgagtcatcatcgtcatcctccgctaatatctcatccataaagctgtagtcaacggtgcagtagccgcagattacgagtccgtgtggtccgcagactaggcgaccatcaggaagtgtcactgggtaatctggacgccaggccatgttggatacaatggtttgaaatgaatgagctgaaagtaaagagaatgttctgcaaaggcttggactcggggttccgagcagacatgtggagtagaaaaagtcttaaatgggtcgacctcgggaggttgaactatgaggatctgcggggagagagagatcacatttctgttaacatgcctattcgcatctctccttccaccaatatactatttatttccctgccttcaatctattcgcattcccccgttttagtgctcacctcttcttttgataaaactcagcagtccattttatccccagtgcgtgctgagtgatcacatatcccattctgttgacatacctgcgtacatgcaatgtgactgagctctctctgagcatttgcctaatttgtctcgtttgtcatgtcgtcgccttatacaccgcctcctttccatagatgcatcatcacctttcttcttcgcgattttcccaacacatcccattcggtcagctcgtcttgatctactgacgttcaaaacaccaacatagtcactatggtcaaccccccgtttgaaccattgaggaatcatgaagtcccctggattttatttcgcgcatcttgcgatggcagagagtgcgacaaatgctgcgaggaagaacccagaagtcttatcgactcgtctaattcgtcagattcttcggcattcgatagccacctctcatggaaaaaggtcccaacgccattcgtcagcttcttcggcacctggacaagagcaatgcgatggcgtgaatggttagagagaaatcatcatacggacatcaaagtggttgccctctgggcaagagacatgggccacgtgtataacgcgatgacggtcgctttgggcttgggatactcagatacgggctctgataatcgacgaaagcttcgaaatcatgaagatgaatacctcgttgacgctggtgtggatgaagaccgaatcttggctgtgtttcgaggcggtggtgatcttcgagctatcacctttattggccctttctacaaggtcacaacatcagtgcccagtgaatacttccttgcccaagaaagcaatcccctcaaagccttgggggagatgatattcatgaacacaggagtgtatgatgatctttggcgggatcagctcgtgaaatcaatcagcaatttcacttgcccaatgcagatagattactcgaggggacgattccgtccgcagcttgagcgggtctattactagcggtttaccctcgtttgtgcctgtaaaggcgtctgtagctcgcgttgtgttcggtttgagccgtgaggttggaatatcaaatagtcctgatagccattgggtgaaacgagggtgatctctagggctgaccatgtatctgacataagacattgcaactaacatttattactcaacaatattacagcggagccaaaaaaaataccacggaattaagatacaatgacatagttaaagtcctgttcctccttcaaccttcacaagagacactaacacaagaccctggtgcctcaagttgctcaattaacgatctgtatgcagtagaagactctctagcgcaggtgaggatgcatctgagaatgcaccatcagacgccatcgcccgacaagccactctccggggattccagcgcttcatcagacgtagagcgtccaccgagaagaccacccaacaggccactctccggggattccagcgcttcatcagacgtagagcgtccaccgagaagaccacccaacaggccactctccggggattccagcgcttcctcaggtgtagagcgtccaccgagaagaccacccaacagaccacccggctcgtaaccacgctctgtatcagagctgtctctagcgttcagcgccgggaggggcaaggtaggcgccttagagaggaatggggttggcttggctggtctcttcgtcagggtggggatgggcgtgctggatgggaccccctgattgcctagcccaccaagtccattgaggccgctgagggggagttgagcagcggcattgctgctcagagctgtcagggtggacagtgtgaggaggatgttgatgtgcattttggcttcttaggagattggaaattatatggattgttgcctggttggatttgaattctgaggagaatgttctcaatcgagggtttggagtttattcaaaagaattgatatgctgggagtgtatgggaaagggtataaatataccggaagagagtaaggaggtgaatggatttgtatagatcacatcgctatatgatggaagcgggaactagatgaagatcgtgatcccctttatgaagatcattgaagattgatctcagccttgacagatcatgtcctggagaggccgtgatagtctgtagcatttgcttttgtgtgatgggattcttatagttcaatattgggtgcataaattggagatcgctggctacattactggattaagtatgtacttctcttttggctcttaaaccactgcatgaatattccatgggaaacaggcatattgcctgtatgtgatgcagatcaggttcggttcaggatgtgattgttttgatcacacaatagtgatttatatcgttcaaggtaagagactactgtgcccgtgaggcattcgatatatataatcagaatacggagtacatcgtacattgtaaaatatgcgacagtctaatctacagagtaaaaatatctgcaatataccgagcacaggatctccccccttagagccaagagatcatccccccacttcctgataagagtcacacttcaacttcttctctgcaaaacacccgtacagcatacggaatagaatggatccaaaagtcggaatcggtgtcttcgtcttcaacggtgcaggcaaattcgtcatcggcaagcgaaagggaagtctgggcgccggtacgtgcatacaataccctataaaccccctacacatgcaacaaacaagcaaatataagctattggaatcaatccttaccatttgtgattaaaggcacatggggattaccaggtggacacctcgaattcggcgaatccttcgagacctgcgcgacccgtgagaccctcgaagaaacaggtctgaagatccaggatgtgcggttcctgaatgccacgaattcgattatgaaagcggagaataagcactacattaccatttttatgggtggtgtctgtgacgaaggtgttgatcctcgggtaagttgatgtttgcttcttgtggttttgcgatttttatgcgaactggattttttccttgttttattgcgtacccccgtatccccatatggccgtgtactggaacagaacaggatatgtggcttacttgtcggtaggtacttgagccggaaaagtgcgatgtatgggaatggatctcgtgggatgagctgcgggcgtatggagaggaggagatgaaggctggtgctgggttcgaggggaggaggttgtttttgcctcttttggaattgtttagacagcgtccggattttcgggtttgaattttattttatttttatttttttatttttttatttttttccaacggttcagaattcatactggagctataacatatgaaattggatgttcggaaacaactactctgtatacgattcaagagatgacataggcctcttaattccttctttcaccccctgatcatttcatatggagacaacgttgatactctgtttcaaaatccccttgactgtaatgtcgatttaatatccaacccgaattaaggaacaagcgagccagaattttcatcagcagcccgtttgatccctactcgcaggataatactcgagatgtatgaccgaattgcctcttgtaaccatagtggcaaggccctaagtgatccagccactgtgaaatgtcgaggaatgatagtttgcccgcttttccgagtaacaatatgttccaccactgcctgggagacgtccttcggatccaggagtggttgaccgaagtcagcttgatatttagtgaagcctttgatcatgggcgtctgaacccaaaaagggtgaatgatactagctattgttagcacgatctctcttcgaagaaagactttcccaaactaacctcgtccgcacatttggagccttgtaccaatatttcaactcttgccgaaggccttcttgaaaagcaagagcgccagatttagcacaagcatagtccaccatctcgcctgaagtgacaaaactcgccatactggctactgtaatgacatggccacggttcatacggaccatagatggaaggaattctttcatgatgagaaaatgggcgatgatgttgacatcgaatgtctggcgcaatttctcctctggcattccgagaatggtgccgtggtggtaaacgcctgcattgttcacaatgacggtcggctctccgtgcgacttccgaatagcagtgcccgtttcggaaagggagctggccgatgttatatctgtttgatagaatgtggcgttctctggaagctcaaaggtaggccggttgatatcgaggaccacaacgcgtactttctggcgagaaagatcttccattatttgcctgccgatgccaccactgccgccggtcaagaggactagctcattctctgggatccatgtatcgctgacttggaagttgtttagaactcgttctgagatctttgtatggaggtagtagaggactatagagcccatcaaaacactcagcgaggatgtgatgattggcgcgctcaaaaagtcgaacatggtgttaatagggagttccgataattacagaatctagtctgagtagtcctcaaagtagtccacgaaggggcacaaatagaaggcgaacttggtcaaattctgtagctgatgtgctggcacagttgtagccagagtattacgctagcatggaattgggaaaagagatgagattgtcaagcaactgatacaaatgaggggcaacgtgttattttatcatgtgaataactgaataactacctaggtagccaatataaatggtagcacggaaggttattcaacctacctaagtactcaagtagtaacggcctttgtccccacacaggggcccaagggcctttttagcttcgagcaagaaactagagacaaggactctgagattactgttgattcttcggggcatgggagtcaaacagggtccagaactttgataattaagacccgatgatagagccaaaggtctttcccatgcattccaagatatagacaaagagggaagaactcgaagagcagcaagggcctcgggactatctgactatctccccggattcggctcgtctaacaggcgtatttaaaccaaggataactgtgctttatattgaaggtatccctaatatcgggtttacggcctcggtcgcaaaccagcgggacagtcttcttcacccctttcttagtgaattttgagtatgcttgtgactgcatagccatagggctgcgcaaaggtattcatgcctctctcccttcctcatatatacggtattgctaattgagcggggggatcgggaatgtaaaggtctgcgggcaatcaggagggcctgtaatgggtacaccatcaggaaccacaggacccgagaagcgaggtttctatagtctttccacgaggccgacgaccttcactccaattagcccaagactgggtatcaatatagttaagataaccagaataaaggatcgggtgcttccaaactaaccctataagataggcctcgcgaattttttaatataagtaacttttcgatgtgcagtgccaagctgtcaggatgaacatggtgatagatgagaaacttcaaggctagatagacgtaaggattctgatagctagtcaacagccaacatggatagtgagtataagatatatatgtataatacagagtagtatagtagaaggaagattcataagagatcccctcttttatagcatgtggcacatatggatttgtttgcacaaagcaatagaatgtgctagaatgctgggttaaagtgaagttgatagaaaagacttcgcagatacccgccaagcccgagacaagaatcgtaaacaccttggcatttgcttgatttgcttgatttatagaaaattaatagaggaacttaatcaactagaaccaaaaacccagtcagatacaataacagcgatagtcgaaacctgtacaactgtcagtcaatctatcaatatatatataccaagaacccaaagaccccaaagactcgaatactcaccaatgaaatatccactccaggcattacaatgacatccatagcaggtcgatacccctgcctagagcctctcatcaaagccaatttctcattatggtgaatactctcccggacttcagcaaccttcctatctccgtcaacaacatcaaaaagcgccagcgcattcccatgccgttcaatatgcaaagtgagcattttctcatctccgcgcttcccctgaaaagcagccgcattctcaaacgaaagatcaaaattcccaaacgaagtattccccagcgtccatcgcggagcgccagtagctatcgtcgcagtatcacacccgggcaagctaaccgaccaactatttgtccacgaccatttccgatgtaactcgaaaagcggcagacccgagtcatcgcggaactcccgacacgaccgatccgtgtatttgcgaccggtcaccgtgaactgtggcgttccatcttcttcggtgatcttatatgcgaaggcggagtggggactgccgaatggtctgagtacgagggttgtttttgagcgcgctatgtattggttgcggaaggcgatgtcgcggtctggtgagcggagggttttgcggggcttggaggaatatgactgcgatagtcgggcgttggagtaggtggcataggacatggttgttgctatgccgtgtttattcacaatacgtgctgggattatgcggggtgcctcttatacctccagggttggattgtatgggcatatcttgcgctacttagcgctacttatccctgttgcggcatttgtcctgtccaatgcccgatgatctcactgatggctgagccacatgccaagaaatatacgtgaagctatcccctcagggcttcagcggggtaagtggaattgacttgtggctacatccggtctcgaatgatgcattttaattaatagcatggattcagccacttctcatttatcaaatgtcaattgctcttgtatgttgtagaactaccaattcagtaaagtacatacaaacataggagtcaaccttccaaggttggatgtattgaagcaacaccccgggcccccatatctgctgagtcatgctccagggccctccagggctggggccagtgctgacctccgaggtctgttaggcttccttgaatatcatcacatctactccgtactgattactcgtactgattactccaacatggctgggaagttcgccgtcagatctctagaccacttggtcctaacagtccgcaacattcccaagaccgtggcattctatacaacctacctcggcatgcggcacgagatctttacctcaccagctaaccaatccatccagaggtaacccctcttttcttttcttttttctttttcctctcttttttttcatgatcttagtggatgttcaaaagacattgacgataacagacatgccctcatttttggctctcagaaaataaaccttcaccaatcaggcaaggaattcgaacccaaggcccaggacgttatgccaggaagtgccgatttgtgctttttgacagacgagaatgtcgaaaaggtcctggaagttttccaagaagccagagtcgaagtatggactctcctttttttttttccctctcgcaaatggtgcaaatggtgcagataagagactgatctctacagattctggaaggcgccaaggttgtagaaagaaccggggccgttgggaagattcgcagtgtatacgtgagagatcctgatgggaatttaattgtgtgagcctgttcccttctctcttggagaaacaagttgattaaccattgcagagtgtcgaactatgtttgatgaacccgcctgggacctatagtcacagaccttttctttcccctttgataccatgattttttcatgttcctcctataaggatattgggacaaattccgattataccacagtcttcacgaacaaagtctcagatcttcttaggattgatgcaggcaactggattagaccttagcccacatctttgatccggtctttattacacgagcagcgaccagaatcaacgcccccagaaggaaggccaacccgccccagatctgcgctccaatgtagctgtcggctctagcaatgagtgctccaccgaggggtgggccagtcagacaggcaaagctcacaatcgtaaagcccatacccatgcggactccggttttgcttaggtcgggcgtaagactcgagagtgttgatggccagagaccctgcacaccattggagaatatgccgtagagaacggcaaagacgtacaggcctgccgtggaatggacggcagcccagcaaaacatcatcacgctagcagccagagtcaggggaatgatggtgttgagaggtccatacttgagatcggccaaataagcagggataaggcggccgactattcctgctccattggttacgatgatcaaattgtccgagtccgagaacgtcaggcccaaagtgtcacgggcaaatgcaccaatgtaatagaaggcgaagtataacgcccagaaattcagaaacatgcccagacagaaaagcacataggtaggttccttgaacgccgaccattcaatgagggcgccagccttacgcgggggtagtcgagtttggaacaggagaatagcagggatgcttgtcccgagcatgacaaaccccaacaccctaaccgtccaaccaaatccgatcgacggcaggagagccttcaccaagccgggaagaagcatacctccagttccactcccaaccagacaaaatgccaaggcaaacaccttcctccccgagaagtaggtcgcgaccagactcatcacagggcagaactgcagaccactaccaaggcctgtgcagataccctgagcgagaaatagctgccaatagcgcttggaaagcgatgtcatgaagaccccgacgagctgcagaagcaccccgacacaaaagaccgagtgaaagaagcccgcgtctagggcccgaccggagaatgccccgacaaagaaaatgaggaacacctgtacggatccaacccatgaaatagccgatgctgaaacgccaagcgttgattcgtagtaggcctggaatacgccgaaggtgacgatgtacccccaggtgttaaacaccactaaatggcccatcaaggcttgtgtccatgccttcagccctccatcgggcggggcttcgattcgggaagattgtctgtcgtgtgaagactcggggtcttcattattctctgtcatggtgggtgcagtgcagtatgaaacccccaatgtgggagaagagttcaagtaggatgattggaactcttcgtgtcccaattccggcgtcttgaattgacattaatcgatgaacgactcaaaagtgtcggattcaagaagcaattgcaacccgtcctacccgcgatacccgcgatacccacggggggctttttgaagagcgcactattgttgggcgtgatatatataatacttcaggatatatggagggttcattagtcgatacatccgggccactgcggagatccgtcttatataccaagcgccggctgatcgaccggctccattatttgcccaatccggctgtctggggctgtctatggtacttttgttctaactttccgatccaaccttgcatgtgggcatctttccctgagtgggcaattggggctttacagaatacaatgacattgaaatgtttgtatagattgggttcgtgacattgcagatgaagctgagagcattattggccatttgaactcagtagggggaatccccttatagtaagactatgctcccaccgggatacctcgtagtcaaatgaagcagtggctggaggacaatactcaagtatctgagttgcgattgttggtattaggtgccgtatctattgatgcattgtgaacccatacccacatcaacagtctccatcaactcagcattttgctatatggcagtgtattgactgcgttttcacgcctactcttagaataatcttctcttctatgactttgtatgtagtgtaatgtagacatcatttagacctatgttgtactataagaagatactaggtgtttggtagaatcacaaaactacggaactaaagaacccacactttttgcctgaccaattggctaatgcccagcattctccataaaaatctggcggttgttactccttacagggtcacagttcatgcggaatgtcaatctcaatatcaatgacgacatcgtggatcagccctgagcaggatagggccgcaccctgctcgcgtaaacagatcacccgtataaagtatctgaatgggtgaatcatgatccttacaacttccaatagcacaaatctcgccgaatccccgaaaatgttttggatttgcccaatccgtcttcggggtatcctgttttgatatgggacggtttttccgaaatatgaagtcttgatgatatgtgtggaaagggtttataacataaatgttgttcgcacacaacataaaagcttttggaattcaatcttcccactatcaaagtcaaggatcaccatctacatgacaggttcaggataactgttccgtgatggtccccccccgttcccgggcggggccggctagctcaggtacgcgatgcacttccattctgtcgattctacattccaattcttttcttttcttttcttttctttttcttttggcacgcaatgacgatattctatccgtggcttaccattcatggtgaaatttgataccttatatgtttcaagacgggtttctgagtgccgattttaccttgtgttttgcaatctgtgtcttagttatggacccatgctaacccaagtgaagtctctagggatcttgttggaaatagaacttgatacttttatcatagtcattttggcgacattcaaagagtaatatagtgtaggggtacctgttttccaactcttttgggcatatggtagcccccgtctttgctagatagatagttgaatagctcaattatccatttatttacatttctccctactatttcactttaaagtaattatttaaacccatacctaggtacccatgtacttgatttctagtccttgccgctttttgctcattaagtagaactgatcccattatatcccattatatcactcatgacatttaaagaaattttggtgttctcgatcttcggtttttagcaccaaaccaaagtgccccgccaccaacaatttctcgtgaacctgttaatgtgtggctggtgcatgacctaacatcctggattctgggggatgagtcgccgatacaccctcaccggtataccccctggagcttgttgctgccgtcaatctccgttcgttggtaggtagctactcggggtgacaagttccgtggattacattactctattaaagtgcgacgcgttcatgcgctgtatcaaccatattgagagtggcagtaactccgattcggaagtccgtaagctaagcttggaagagttggctttctgctccattagtttcgaaaggaaacgccttagcttcgttattcgccattttaaagcgtcgaacatacggtcttacagaaaaggcacgggcttcctaccttgatcatcctgaagtttccaaacggctgagacatttatctgcagaatctgaaggacaaccattttatgaggtatatggggctgccaatgaagcacgtaagaattctcctgagagtctaccgagccgggcgagcataaggaccatcaaaaagcaagccagcagaaacccattgttgaagcggggtcggctagccgtcgaaggaagatcaaagcgaagagaacagagacagagatggaaatagaaacagaaacagaacagatctcggtcatcaggtgtcattttcgagttgatggaggaagatggaggaaagtggattgctgaatggaaaaacaatgcagttgatgtacacggttctgccctcacagggttcagcttctcgttgacgactactacgccttctcatccagtcgcgagagagcgtcgcatagcgagatgcgaagttcgggcgccgccttggtcagaccatcagcgataaactgcagttttttacctatccaaggtgtcccacttctttcggcgagagccgaaagcaatcttccataagcccaacaatccgtggcaacccttgcctcaaacggcgtgttggcagggcttgtttcaatgttttgaatgagaatctgcatctcaggtgaaagccattcccacacgtaaccaccggtcccgctaacatcgatcaggacggcatgttcaccggcatccaaaacgatatttgacggcttgatatcaagatgagtacgccctctcttgtgcaataatctcaatgctatcccaatttgtaaggcccattgtattagcaaagtatcaaattgagactcaaattgagactcatcctcgaatatttgctcaagtgaccctccggaatagtattcaagaagaaatcctgtgatcactattggcatatcggttgacgggcaggtcttatacgggttctctgatacaactaggccaactagctgcgcgatgctcggaagcccgcggaattgtgtaaggacgtcaatctcgttcaacatatgttccgtgtcttcaggctcatagatagggcggtcaatcgttttgtaagcaaatatatgttgctcaaacataactttggagactgttggagcgataacatcaatagtctgcaaacaaccagcctcaaatattggtaaacatcgatcccgctctagagttgggtacgttgggtacatgaccctctttggatcttctgcgatcttgtagcagatttgataggcaatggcaataaagaagttcgctgggtcttgatggccatgcccgtcccgtaacatgatcgagttttgactttgcccggtcgaggtctgactttgctcggtcaagcttaaagtaatgtttgtcacagtatcgtctaaaagctgcaattggccgaaatcaatcgcttcaaggaattcttgaaagatggaccggcgtttcaaatagcccagagctaatacctgtgttggcagtgaccaatccacggtaactttgatccaccataaagagccattgttgtgaaatatcagggtctgtgatggacggtcaccgttccagtctcgaaatgacttgaattccaatctgtacaagggtagcggctcttcgggcattgcgatcaattgcagaaggtgggcactttagttgacaaaataagagagaggaataaacgaaaaatccctgaaataaactgactggaaagggggaaggggtggtagttaagttgatgctcagatcacgtgtggttcataagaagtttgactgatcagatttggtactcattcatatcgttgtctttctttggcagttattacatataccaggaatccttccaaggtttgattggattgaagttgtcaagcatttcaacggaagaaatctggctgagaatctgtagtatactctatcacttgacaattctctccgataatgagatatcacaacaaaatcgaggcccatcaaaaagtcgcaaagtagatagatagtatcgtgccaaggtgcttattcgggcatagtctgagcgtagactgagtgctcaatagttagatgcctcccgaggtctgacttacctgctgataaatagttaaatccgtaattccgcaatatcacgaaatcgccgtagaccgggtaacaccccggattagcgagtgataagcaagagcctgcaggtctatataaaccacaggtccacagaaagaaaactgtacacttcactcgcaatcaaaatgagaacccgcctcactcaatctcccctacacgccataacccgcacagcattcagaatcagcccagcacacctggtatcccgtcagacccatctatatcgaacccaaacacaaccactccgctcattctcctcttcaacccgcaatctggctccagcaccagcaccagacatgtctagcgctttaatcaatctcgctaagaataggcgcacgatctacaagctcggcaaggaaagtccagtcccagactccaagatcgaagagcttgtcaatgccgccatcctacatgttcccagttcattcaatacccagtctacacggctagtcgtgctcctgcacggtcagcacgacagactgtgggatatcgccattgaggctttcgagggtcttgttaaggcgggtaagatttcgcaggagatctgggagaaacagacattgcctaagttgctcggttttaagggggcgtatgggacggtacgtagtttggctttcgctttccctttcgaattcggttttatttccttgaaactcgaggtatccagtcctgtccatagctaatcaatacccagattcttttctatgaagacccagcccacatcaaacccatgcaggagaagttcgctacatacaaggataatttcctaccatgggcagaccattcgaatgctatgcatcagtatttccgtatgtccatttctttttcgtttcccttcgtgtgtcctttcttcgttctaacgtttaccagtctggacgggccttgaagcgctcggctttggagcgaacttgcagcactatagcccgctcattgatgctggcgtttcaaagcaatgggatctgccccgtgagtggcggaatgttgcccagttagtctttgggagtcctgaggctgctgccggggagaaggtacagaagcctgttgaggagagggttagggtctttgggaagttgtagggtatagatacagataaagcaggagtaaggaggaattagtgtgtatagacactctggtatagattaaaacatcgtaaaagggatagacaaaaccatcacggtcgtgccttgtccctttattctttccagcttgattgccccttcacctacacagttacagcgagatgtgttgtttctccaccctttggggtgatgtacgatatcttcattgaagggtactgtttttgacgcgttatatatgctgataactcaaaaagtcccatttgatttttgggttctaccgtacaaagctgtagaagcccgcccaactccgacacaaataccagaagcattgtctcactggaaacctccttggtcgatcatatactcgacaacttgcccagtttgtctaacacaaatctagccaattctgatataactagtatcttcaggcagcggacgccagtctaagggactttgagctccccaacgtctttttagacaccgcacgacaccactatgaccggtgtcttggcgtagccagtcccggacaatttgagatgagtaaagcgaacctccaccatttgtggccctaggaccggaaaggagaacggcatccctcgaacctagaagatgtgggaggaggcaaagctgaggttctgactgcggagtcagataatgtaccacctggaagttctggggcactcaccgttctttactcttttaactctgagttagccgaatggcaaatcttcttcctctgttttccatatcgtcaagagaggtggtgaccgtcaccctgccgtcgatagtcttagttattcgcacctcggctgtgatatataggtcactgccatcttgggagataacgaaaacgggcctatgtacgacttagtattagcactgtatagcatagctgaggctgaggtatagaaaggcaagtctcaccgcttggcatcgacctcttgtgtcatgagcagcgaagccacttccgtcgtctcttggatggagacttggggctcatgacaatttattgatcctgccttggcctcaaggatcatcttcattggcccatcttcctcccaaagtatccgtcgacttgcgcctccatttctgcgccattgcccagtttggccttgattggcttccgatggcggcccaaccgctatgtatgtagggatgttcggccgcgaggcataaggaaggctaccaggttcatattaacggggtcctcatcaatcagccgttcttgttttgttacctcttccttgagtagcgccaagataatcctggcctgctcgaccgccggtacttgaaagactccggcccccaagccagccttgatcgcaacggaagagagtatcccagcaacgatggcagcaccacgatagcaaatcgtgaaacccttactgctgggttttggtcctgagaaagatggaataccgtccatctgcaatgtcatagacggttggatttgtcttgaccgtccacaatatataggtgtcttaattgggtcgtagcgagctcgacgaatttttgtaaggagatctataaccggttagcaactggcatatgaccggtagacaacggtacgtgccttgtcgtctctcttcactacagtggaccgaggacattcctcaaggtctcattctgtgggaggttcttcctcagactcagagaaggcagatgaccgtattggtgatcttgccatttctgcaaggttcttgcctcacaatctttgcgtcttcgatgtacacgaccttcgagtaagttagattacgctccaagtctccaaagcaaggctagtagaagccacttacccagtgtctgaaatgctataatcaatggctatggttggtaccaagtgccaagtagtataggatattgtgtgaaaaagaaaagaagatgatgttctcggacgtgatacgtgggaagtggaaagtgactatttgccaaagcaaaaaggaagctggggggctgttgtttatataggtacctactaaacgatggtcacgtcagctcactctcatattttattgatacataccttgtttgaatcttaccattgttttataacctgcattagaaaagataatacctactagtgggaggccaagagaagagcgagagaactgtctctatattcacgacctaaccactggcatgaagctctctaaataggttcatggagacaaaggaacaaaggcacaaagacatgaagacagagagagcctcaaattggcaaaagagaggtttgacaatctgcatgtaagtggcttaccccaggtctatgtcaatgcatcatatttaccatttccatgagcctcagatctatgcatgtccagagaccgggtagttcacacctactgaaatgagaataagcagtcattctatatccatagtagttcagctgttttaatcccagttctaaatcagacattgttagcctagaattacattggccaggcacatatgtctacagaacgtcgtcaagaataacctataagttcaatggagctaagacttctatacacaggtgtcccttggctcaagtatgaatatcagaaagaacaatcacccaggacgacagaaaatagaacatacctccaaagccacacaaaccatctatctcccagtacgataccaatactcagacggatcaccaagacactcgccaacagtaacagctataagcaaacgttagcctcaagccatagacgtacaaaaacacaaagaaaagagaaacctacgactcagccccctcctctcaacatccgcaagcatattatccaccaaaatctcaaccgtatgctgatgcgaatcatgtgccaacacaatcgtcccaccagcatcaacctccctcgagaacttttcaaaactaacccaatttgtatcgggattatcattctcatagtccttagtgtcaacactagccccgataacgtggtatcccagatcggccatagcgccgaggacgacgggcgtatgcctgaggaatgggggacgcatgtaggtcgggaagaagccaaggatgtgcatgaaggtttcttcaagaagtgtcatttgctgtacgatctcttcgtatgggagtacatcgagggagggatggttccatctggatatttggttagtgtatgttggtgcttggactggacttggatagagaagggaggagagtggataggccagtgggtgggcatcaacgaacgtatgagaccccagctggtgtccttctgccaatgtgcgctgcactacgtcgggtgatgtatggatgtttcctctgttatggccgttgaggaagaaggttgctcttgcgccgtgttcggcgagagtgtctagtatctggggggtgtagatgtacgggccatcgtcgaacgtgagggcgattgtgcctgggatagtacaatgagtgattatggctccgactggtaggctggtggtgccgatggtattggtggttgtattggtgttgatcctggttcctgtgggagtggcctgggatagggttatagccgaaaggaatggaattagggggatgaggaaatgcattgtgaatgaatgaatgaagtaggtcggagtatataaggataattggaacgaccagtgatgttgattggagtgatggggtgagggagagaggttggcaaggtgttcggctgcaatgccatctacgctgcttcctaatattcgaatcagacaggactcgatgatttgaacataatcagcattgaatatggctgaacgtttgaagattccacccccagttctcatggtagatattatatcttccacaaataaatatgaatacatcaaattagaaaggtaccaaaatggcagggtaagacattcaacccgcatctttcccacagaaaggagcgagaagatagcataagaacctccagaacaaaagacacccgtctaacccttccgcgtgctcttcttcgcctggcgtctctgtcccttctgagcctcacgctcaaggaacttgcgctgctcgtcggcgcttaatccacgtaggattcgctcacgctcatccttcttgatcttttcggcagcaatgcggcgctcctcggccttctcttcctcgtcgacacggcgcagcctcttgatctcctcttcgcggacgttacggactttgcgcatgacttcgccacggaaatgggcggaggcgaccagcttgtcggataggcataggaactggttgaacaaagggagggtggaggtatagccggacggggaggaggcgaggttagcggatagctggatgcgcttcttaggaatggtctcgtcaatccttaaaacacaaatcgttagcgacggatctaagcaacggatctaactaaaggctcgcacagaggctactcacttagtgggtctgtcgataggctggtccgtcacgatcaagtactcaaagtcattaccagcctgttcaatggcctggatcaactccggggtgaggagggtatcgctaatctcagcgctctcggtcatcacagtgacccacgaggggagcttggggctatccttagagaaggtgagagaggcatcgtagcggtcgttgcggaacttgcgcatgtggctcttgtggacaacagcccagataaagccgtcgtaagtcgagctagggaccttgacgggagcagaatccttggcgagaacgggaaccaggtccttctccttaccatcgaaagcatacgctagagcctcgtatttctcaacgggggtctcccaactctcgaagaaaaagctgaagacatactccataatgaaggtgatggggttgtatcgcttaggcatcttaaggttgacatcgaggaaggcaacgttctggcggccggtcgcatacgaggcgaactcacaggcagacctctcttttagcagggactcgggattggcgagctccaaggtgatcgcctcaccgtccacggcagccggtcgggcgattccatcaaatccgacgacggcaaactccttctgaagagaaggtccgtgggcctgcgcccagtccctcgccctctttcggttcttgcgcgttccccagaggtggaagaggacaatcaagaggatgaccggcatgatcattgcctcctgcttgaaatcgctcggggatgtcctctcccatactcgataccaggcagtgtaggggacctgcttcgcggctagggtgttggctgctggggcgacagtcgagtcagcgacgagggaggcaggcgacgggttgggagcttccacgaagtcggcgaagtctaccagagtcagctcagcaattgaaatgtatcaatcaacataccatcgtcggatttagcctcctgagagccaaacacattcttgaacatgcccgccatattggaattgatatgacatgatggaaaagaaaggagtgggaaccaagaggtggtgcccggtgcggagctaagttcctcccgggtttagcgctatctccagcttttttacccgcatcggaggtatttaggcgatttaggcgatttattcgattcgaggaacaaaggagacatcataatttagacaccaaatatccaacctttctctagggaccccataacctgccccaaaataaataaaaaatacagaaaacccaatggctaatgagtgtggtatcatataaaaatgaaacccccgaacaaaactcaacgccagctgtaccatgacagaacccagttttgtacaatcccgctccaaagaaataccagtttagcccaaaaacgaggaagaacagaaaaagaaccaagaaaccgtaagaaaaatgcagaaaagaaaagaaaagaacggaaaaggaaatcgtaacggtcatgctcgaggattgctcaagtcgaaagggatgtatggaggtaagagctcagtggccatacgccggaggaggactgtcttcgtgctggcggctccagaagccgctgcatgcgtttgtcataagtttgtcctcacgcatacgacgagcgatttcaccggcgagtctgtcgaccaggacaggatcgacgttggcgttctcatccttggagaacggaagaacagccgcaggcaacggggtccgctggttgctagacggtcccgcctcagccctctcctggggataaccgcgcatagtagcacgaggggtggcgtccacatcctctgccttgggtccacggatagtctcatgggagtatgataagtccgcatcccgacgagtggggcgggagaagctgggcaaatgcctttcggggataataggtaggtggcagtcgacctcgggtgacagaggtggtgtgactgggtcatctgatggctcatttacaataggcagaggtgcagaggcgatagaggggggtctagacgactcggtcataacactctcatcgctaacgctcatagcgtcatcggttgtcttagggcgccgcagatccacaacacgcttcttacgtttccgagcgtgggctttggaatgacgtccagcgcctagactcagaccataggtgctggtgctaaatgaatggctagacatggagggtcgactttgcatggaggcattgctggcggtttcgtgaagggaagacatgcttcccatttgcgactgctctcgcgaaagagtcgggcttagtggtgagatcacgctcgaagggaattcgctggtatcggttggagaggtccatgctcggtacactacttcctggatcgacggagtgaacaaggacagagtacgttgcgaatctgtcagagcggccaggcgaaggaggttcttttgtgagaagagggagtgggtctctaccgacgaatctagagagagcgacgcgatttcggactcatttaacgcatttccgagggagtcgacgggatcctgtggcgggctagctagaggatcttgaccggggccttcgcttgacttggctgtgttatcggtctcgtcgttcatttcctcccccgtgcgatattctggaacccacaagcggagcgacagtcgatgaatgatggctgggagttcgtccataaacaatatccggagttgagcttcgatctctttttgtaggaagtcgcgcacgaacgggatcgaatcgaaggtcgacgaaaccttaagcgactcaagcggatcattacggaacacgactgtgattcctttttgttttgagaaaactagtataacgaatccagagagtttaaaatcggagagggtgatttgcagaggtatagtgagcggagtactagaatcgcatatcagcaaatatatctgaaggggagaagtgagactgaagacgtacgcggcagcaagaggtactggcgagccgaaagttggtcgtgtgaggaggaaggtattgagcggatttgcctgaacccgggtcttcaaggtgagaaaagcgtcgccagtgtatgacatcttaaagatgccgcgaaagcgatcctcggccaagtcaccgatttccaaaatttcgagttcggggggaatggatcccaagttcaactcggtgacgtgaatatcgtcgacgattattgggggttttggcgatttattaagggcggcagtgagcagatcttgggcgcgagtgtaaaaactcgcgtccgccatcaaaggcgaccagttgaagttgaacgccatgccctcgcattgagaaagtattaaaaggtattaaaaaggtattaaaaggacattagaatgagactctctatgttgtaggagagggagagaagaggcgggagggcaaaagggaaaaaaaaggcaaaagcgcacatccgaggcgcgtgccccgggacttgggactctttttttattttacttctcttctctttgttttatatatataatatataatatatagtatattattttactactaactatctactcttctacctgtatcaattaattcttcctttttctctttcttttattgtctgtatcgtccattctttcttagtacgtcacaatgtgactttgcaggaaccaattccggtcagccccggcttgatgcccactatagatgatattggaccattcaccgttcagcgttatccggcttatatctagactcttcctttattatctctgactatttcgcgaatctagccctcgagagaaaggggggaaaacacgggataggtggatacacatgcttctgaaagtcatactaataatgtacagaaacacgggggtgcagatcttcaacggtctgagtcccacgttcgtttcatgtacgatgtaagggaaagactccgaaggtccaatatcagagcaatggaagaaaaataaaaattgtatctcttgtagggagtataaaacccgacatcgaccgtagatataccccaggcttgtgggattagcagtctttccccggacgtgtgcctttgttactggacatagacatatccccaaatatttatctccaatgtgcaattgcattctgatttcttatgcttttaatagtcaacaaatcaaacatcagttaaaatatacaacagtccaacagtccaacagtccaatataattccaaaggccaacggcagaatattttttaccgcagcaacaccgcgctaaacctgattaggctaaacgtcaacaccggtcgacgatccagcactccggccccagattgactgtcctgacctcattcggtcgaacagaaccatcctaattccactaccacaggtattccaagccccagattaatatactgggtgtataaaacttccccaatgatgtcgacccggtcacactcgccagtctcaagtcacgcgacaccaatggagcccaaacaatccaaatccaagtcagtggttcaacgcagagtatacgggaaacgaagagccaatgccccccgagcggtattcgaccaaggaagccctgtcaaggacgccagattcaagacccaacgtgtcgaccccgtggaaaacctccaagcgaaactagcccaagtgacaatccatgacgactcaacccctcagtcagacaatcgtgcagagcctacaaagactgagagcgagcagcaccaagagctgacgaaagtcgtctctgatgaatcaaattcgtccgcgacagaggacacctcggacaccccgacaacgccgcaatcctctggtgaatgcaccccggaggagacgaagccaaaatcaacgcgatgcgaaacgacggtggaggtcagagaatgcccaaaggattcagacagtctccccctgattacaccagattccccagctccgacgtcagagtccacaggcgaggatcgagaaaagccaagtacatcttccgacagaaggagagcggaaaaaaggaagattcctgcacccaggcgatcgtccggagtcattcatgacagcaaagctagcgattatgttcgcccaattctggatgaggctttgtctccaattgctgcgcaaggcattcagaagttcagctcatgggcttcgcgatcagcgagcatgttcgacgtcgcaaaactcgcagagggatcctacggtgaagtctacaagcttcacctgcgggaagaagcttgtaggccagtggtctcaaaatcaaagctagctaaactgaaatcatatggcgatggagtcttcaaagtcgtgcctctgcgagcaaagagcggtcccgggtccaaaaaattcaccgccattgacgagattgtttccgaggtcaagatgctcaagtatctagatccaatccctggctttgctcgcttcagagagatccatgttgtccaaggtcgtttcccagagtccttccaaaatgcatgggaccactacaagaagaccaaagatgactgcataaatcctaatccgtccaacaaaagagcatatcccgatacgcagctatgggcgattgtggagatggatgatgcgggatgtgaactagagaagtttgcttggtcatcgattttccagatctatgatattttctggggagttgccatggctctggcccgggcagaggagtatgctatgtttgagcatcgagaccttcacttgggaaatgtttgtatacgatcgacgcgggaagatggttgcatggatccccccacagagctcgacgttgcacgacagccatcgtccagtggatttggaatcagctccctcgagactaccattattgactactcactctctcgcgcggacctgctcttgaccgatgatcccgccggtctcaccgaggttgcgtcatcagatctggacaagaagcagttgttcgatgctattggccaagacgaagacgagattatgcaaagaaacacctaccgatagtatgtttcccaatgcctacttactttcttacacagcttgctaacattgaaaatcagtatgcgcgctacactctatactggttgccccacagaaacagaaaaagtggcggatatccctggcatctgggcagaatactccccacgcaccaacttggtctggctactatttctgcttcagagccttttcaagaaccgcaaacctgaaccaccgcctacacagccacagcgaaaagctcttgcatcttgctcgcccaacaagatgacacggaaaccggagacggccaaagggaaagatcagaacatcgccgaatccctcgtcaaggagaggcagacgaaggacgtgcaaactggtatctcgcagctcaagcaaacattagatcacaggctaaaggccgtcctcgaacttctcgacttggagcatggacatgaagatatgtgttgcgcagcggatttggtggcctacgcgatggactcgcaatggctgggtgaacaagactttttctgatgattccttagtatacaaaaagcattagcagacgggggagtcacatggtgtttgtcattttcaaggttaggagttatcatttgtttacctattgtgggcttggggattggcgttggaatataacatgcaataccttggatagatcaccagtataacggaccttgaatatacactaccttcatacatattctacatacatttttccatgcgaatacatgactctgtctacttgcaccttaacttatgagaataaacacaacttcgtgtttttctttttcaaggaacatcccacagccatcacaaaccgcctatcggcttcccgccaagttgctatgccctctgacagaagagtagttatgtattaggactttttttttctattctagcagaaacgcccacttccaaatccccaaccttttgtaccggggtagtaacccgcggatgactagatgcatgtatgtactgaaaaccccagggaggacgaaacaaacagcctagccgtaaccccgagacaagaagaaagaaaacgccatttcaaagctttcaacaaacgcttttcggacccatgcttttccacagtcgagacaacgatctatcccaactggatgtgcagtaaaaaaggagatattgtcagttcgtttcataaattcgtacacttagagaacagttccagcaccgacacggaagagcttaaccatcagttcaggacggctccagagtgagaaggacttctgatcagtccagttcagagactgaggaagaagctctaggtcgaagttccacaagagcttggcgagcaggagacgcatttcggcgttcgcgaggctgtagatggaatattagcaaacacttccagatatggctcaggtgaaaacacggatggagtgagcaggcagtgatggaatgtgtgcttactgttgaccaagacagttgcgtggaccgtaagagtagggttggaaggcctccttcttgtcattgatgtactcatcagactcgttcagccagcgctctgggacgaatgcctcggggttcttgaagtgcgaggcggcacggaaggcagagtacagcgagatggagacggagacctgtttgtattcaaccgctgtcagtatcgaggcgtggaattgaaattgtgttttgtgctgagatgggaatagccgagggggacctgtcttctctagaacaagttcatgctcggatatttttccgcaaacaacacacaccggcatgttgtaattacctttccagggacgtattgctcgttaatcatcgctcctccttcgggaacgatgcgtggaagcatggaaggaatgggcgggtagatgcgcattgcctcagtcaggacagcattcaggtacgggaggtccccgagggtggacaacttgatgtcagtgtccttgtcaaaagcaccacgaatttcccggaccaagcgtgtgtacttgtcacggtagcgcagaaggtagtatgtcacaccagagagaagggcagcggtagtctcgctgccggccaggacgaagaccgccgagttcgcatccatctcctcaggcgacatgcccttcccatccttggaatgcttaaggatatatgaagtgaagtcgggacgggtagcacccagggcgagacgacgacggaccttctcaacgctcaggttgaagctggcttgacgtttctggagaaggtgcttggggaccaggacacgcaccaaggggacgaggaaagggtagtaccaaaagaccttgaggtaggcgcttgccttgacggcatccagaataattcggacccaccagtggtatgtgctgtttgacaagcagccgaagggttctccaaaagcgagatcgccaatgaggtcgaatgtggtgaagttgaaccagcaggtgatatcaatggtttgggacgcggcgctccccatgaggcccttaagtttttccatgaacatgttggcgtacatctggaggatttcttcctgctcgcgcaaggctttgttggaaaaggcgtgggtcagcaaacggcgcatccgggagtggttatcctcattggctgtgattattgcattaacaccgttgggagtgggtgcatacaaggccgggtccttgacgaagactttttggcccttcttgcggtgaccgtagatatccttccaggcgggtgcggcgcggtaaacgagagcattcggagcaatacggaccacgtctccgtactggtcatggaggcgcttcattgtcgagtgctgcttaccctggatgtcccacatgaggtgaaccaaaggagtgatggcagccagcctgggtccagggtagccactcagagggtggaagcagagagtgtggatgatccagcccacatagtaaacgcacagctgtgaaaaagatattgattggaatgagacacatactcattcaatacttaatcttatacatcagtactcaccaaggcaaggagtccactcagtagaccccagaacgaggggacagctagggcatggcatcggacgcccatagccaaggaatcgaaaatcgtcatgaacaataactagttaccgtaagacatacgaccaaagacatccagagaagttcttcttactgaaagacaaatgtaaaaaacaaatattaaacgagggaacggtgtgtgggaaaagaagagaagagaaaagaagaagagagaggcgaagcacgaaggggaaccggagtgggcaaacgacagatgagatgataagagatttacaatagaaattgattggagacatcaaatggcgggaaactgtttaaggaggtcgtttagggtcccaattgacttgtgtgtgtttaagagcgattgaaaatgcgaaggcgacagccggcaaacttcgacttggagtctcaacttagggctcctcaaacggaaaacaggggctacattaaaggactcaatgggtcagctaacaaaggagtactcacgcggagatcaagtaacggaagaattttcatggctcatcattcgttatatctgagtctactggatgagcgaaatatgccaccaaaatcaaccactggcaacagagaaactcaacaagctcccagcagccagtccaccgacaagaaccaggctcatgaatccgccagcagccggtctttcgtcggcaacaacccagtgactagcgcccatcatacagcttgtccccaggtacccattggtggcaccgaagaagaactgtacaaggaaatagaaaacgtcactcttgacagcagcaccttcgccgttgatgttgcagagctggtacatcggaatgaaaataacacgggcaatagccacaatggcagccatctgaggatgctgtcccaaagacactcctgggatagccacacacattctcccggccaaatcgcccagattccaaagcaaaaatgcgaaaggaacgaagacactaggatcgtacatccgtgaactggcagggtcgttgacggacttgatctcggccgtatagactgggaacaccatagaaaccaaaaagcagacgaacacagcaaatgccagaaaccgcagcttaacgaacagagtccagaggctgacagtcttggaatgttcgcggacatccgcaatagactcatcgtcatcccttgccaacttttgcctcgaagagggttgctgtctcagaagatagaggaaagccaacagggcaatgaccgagacacccgtagacgtaagaaaatatataaacgcagacgtcgacgaactcgtctggggcatgctggggtcttggtctcgaccttggtctcgaccgacgctatcctccttcggcggcacagccagcacagagaagatctgaacaatgcaaggcaacacaccggcaacaccctgtccacccataatagcctgggtatattcctctctaccgaacccggagacgtatgcaaagacgccattctggttgataccagtggccagactcgcggcgcacaccatcaccatcaagaaaccaaagtacgctcgcggcgaggaatcggtcatgactactgctgagaaggccaaaatagtgaacacaacagagttcagcaacagcgaaaacgttattcgccgtggataggaggcgttcttctgtagctttgctagggcataggcggctccgaggttggtgacggttgacatggactggatcgacggttggtagtgtagtcttgtccagtcatcggactggaaccggctgtagaaatatggtgccgcggcgaggaacatgttcctagatcgtgctccgcattagtttcggttggctcaactcacacatgtatgtagcttgttcctccgggttcggagattgttgagttccacttaccaggcccacaacatagacactccgaggaggaagaatatgccatactgtaatcttgaaaagtgagactgcagctgtcgctgcgtatatgttgtctcatcggtgtcgtctgcagcggagtcctgcagtcgttcgtacgccgccggacgggcgatgagactacgtatgcggttcatgtctgtcttttcaaccccacttcctatgtaaaagtaaaatattctgtaaaaataaggggattatctcatatcaaagagctgtaatgcgccgtttgacgttggcatatgactggttactaagcaagatacgtcgcccaggcggccgcgggaccacccgcacgggactccgggacaggcgatctatgagttctcctgtgagagcccatctgcgactgccatagcttgtgttgtacatttggggtctggacaaggttgtagagcggtgccccgaacaaacaatgaaacaataatattgatatcgagatttgtacacagtaattgctgacttagtatctatcgcaaaatctaacatgcaaaatgtgcgggagtatgagaagagaggaagagtgagaggtgagtgtagatgagggaacatgtattccaaggagaaaaaatcaacaagaatgaaaagacatcgtaaggagatggccgtgtaacggtagggtcaggagtaaacaaggtgtggaatacgatcactccttcttcgaagaggctgtctcctctacctcttctacgtcatcttcctccagctcaggctctaactcctccttctggaactcccagagctgatctgtctccatagacttgaccggaggtggcgttgtttcgccaccactcatttgccattccatgagcttcgtaaaggcgccatccgggtgagagctgagctcctcgtaggagccttgctcggcgaccttgccgtcagggccaaggacaatgatggtgtcggagcgcttgatggtggaaagacggtgggcaatgctgattgtcgtgttgttgccgcgaagcagagcggccaacgcactgttgacgagagtctcggattcggcgtcgagggccgaagtggcttcatccagaatcagaatgtcaggttccttgataagggcacgcgcaatggcaatgcgctgcttctgaccgccagacaactgggctccacgggctccaacgtgagtatcgagtccatcaggctgtactaggttagctaggttcgccaaaataatagctggttggcggacttacgaagtcgctgatgaattggcaattggccttgcgcgcagcagcaatgatctccgatcgtgttgcttgaggaatgccgtaagcgatgttctcggcgattgttccagagaagagcacaggctcttgggaaacaacgccaatctttctgcgaagggacttggcgttcatgcccttgatatctttcccgttgatcaagacccggccctcggtggggttatagaaccggagcaaaatggatgcaatggtagatttgcctccaccggatggtccaacgatcgcaacgttagttccttgaggaatctcgaagttcaattcctggaagatcttcacagcggggcgggtagggtagcagaacgtgacgttctcaaatcgaatgggtccacgcgcggtctcgaccttgagacccttggttgggtgaatcgtgggctcacgatcttgcagttcaaagagtcgactcgccgcacccacacctttcatcagctctgaatagaagctggagagaccgaacatgctggagcctgcataagcagtgtacattaaaaacgaagtcaattctccaatgctgatagcacccgattgaaccatcccaccgccgacataaagcagggtcaagatcgtcatgttgcccatcaagccagtctaggaagaagtcagtcaaaatcaataagaagccagaaagaatcaagactttcgactcaccgagctgaagaaggttgcgctaataagagactcttttttgccaagctcgaatattttgcgaacttgtttgttgtaccggttgacttcgataacttcaccggcaaacgactgactagtcttgacgttgcccaggcgctcttccgcaatcttagtcaacgatcccaggttcttttgcattttgcgactgatgttcctaatggctcgaccgtaaaagagagcgccgagaccaattggaggaagcaacacaagcaagatagtagacagctttgcactagtataggccatcagactgaaaccagctgcaccgctaacagcagctcgtagaccatcggacaggttctgcgtgatactcttgccaacaatgatagtgtcggagctaaggcgcgagatcagatcaccaacccggttggcatcaaagaactcggcatcctgcacgaaggtttgacggaaaagcttggaacgcagcctagcaacaattcgctcaccaacaattcgaagaatgatgatgcgcccatagtttgcaccagcacccagaagtagaattccaccgagagcagtgtaaaacatgggcatgctcaagccgaacagttcgccccctccttcggttacgctcttggtggcagagtccatgattttaccaatggagaagggaactgccattgtgattgaagaggagattaggaggaaaaagaaggcgaaaccaagggccttggattcagggcgcgcgatcttcaaaagccgccagatttcggagaatccggatttctttcccgatgcgccgtccttggccaacctggcgctcatgttgacctgcgctgcctgcgctgctcgctcagacaattcgaagcccttgtcctcctccacttcttcttttagttctggagctgaccgggtagttggcactgtggaggatgcggatggtttcgcttggaaaagttgggaagttgaacataaaaagcatgcttgggagacaatgcgagacgtagaaggggtatatttgaagctgttgttttgaagcaagagtgggttcgcaccatcccggagtgtacccgaggcggttgaatagagacggttcaacccattgtggtcggcggaagagataataggcggtctcgctttaggaagtaggtcgcgagtaaaggagctatatggtctcaaagcctgccgtgggctgacacccaaggccagagacacaggcagcctggcactgcgcatatcggagtcggatcggacaaggatcgaaacggaattggagttacaatgatgtcaccgaataagacgtcgacatgccatatctaaagggaaaaagttcaagttgagcacatcacatggcacacattcagctccttggaacgtgcaatggactaggagcggatgtgtctggagcttcgtccgacgcccacggtcatcggcaaagcggttttcggggccggttttgccttagtcgaccgctcgtgattttgcccgtgcttaccgcccatggaagccggtcgagagctctagatacttcatctgtcctgggccagaagcttcatttctttcgagtttcactaggttgaaacgcttcaaaaatatatcggtaaatttgctgaattgtcatttgcatcaggatcgtcaaaaacttttgttcctcccctgtttcctctgccgctgatacaccaccccacctctactcctgcacactcactgtcagacaagatggtgcttgactacagcaaatgggacgccttggagctgtcagatgactcggatatcgaagttcatcccaatgtcgacaaacgctcttttatccgagcaaagcaagcccagattcaccagcaacgagagcagcgtcgtcatgaaatcaaaaccttgaagtacgagcgcataattaatgatggattgttgtcacgcatcgacaagcttcttgagtctctgaagaagcacgaagactcgtctgcatcccccgacgagttcattttcactacaatcatggagttcgccagcaatcccgccgaagatcaagcccccaccccgccggaaggagtatacacacacgagccggaacaacccaagttttcccagatgatgagctcactggtggaccaggtgaaaaaggaaattggcgattctaagcctgagaacctcttcaaggcatacatccagggtgtgaatggacacttggaaaagattcaagcacttcaaaaggaattgttcgcaaagcttgcgcaacttgagaaggaggaaggctccaagatcaccagcgataagctacatgaaggtttcaatcaatcgcatgtggccaggattgctgagaaggagaaggcggctgccaaagcaaaggagagctctgttgaactcctgaaccctggtgcaggaagctccgccgccaaggccgatgatgaaggcgatgatgaagatcctgccgatgtcgagattagcccgctagcgaagaagtttgctcagctcaagcctggagactacaaggcctatctacagttcatctcagcgaacccggaaattgtcgccgagaaagagactgatggtctactcgttgaggcgttcaacagtcagctcaagggtcaagatgactatgctcgccagtgcgtgcaccaaggtcttcttctgcaatactgccgttcgcttggtcgtgacggtatccagctgttcttcactcggtatgccaatcttctgcccgtatttcattttctcttcttcagtcaatggctaacatataaccttctagcatcaccactaaagatcaccgcgcatcaaccctgttccttaatgatgtcaatgaaacttacgctcgtatcaaatcccgctccgctgaacttagcaaggacggctcagcgtccaacgatcatgcgggcgtagagcaaatccagctgcacgccgttgaccccaacaccaagataaccatcaaccttcccggcgccaacagcgaagaccccgttgagattgaggcacgcaagatcttcgacgctttccctgaagacctgcaaaaggcactggcaaccgagtccttggacgaagtcaacaaggttctcggcaagatgtccgttgatgaggcagaggtcgttgtggagcaattgggcaatggtggtatgctcagcttggaggaagggattgtggatgcgacgacagctgagggccagaagaaattgaaggagttggaagacgaggggaagcaggaagtgggtgagcccggtggcgacgttaccgagcttgactaaggatatgcaaaaagcgatgatgatatgaattgagtatgcatttatttatttctcttaatccgagaacaggttagcaactactcccaatattatcgtacatttgtaactttccattcatcagagctaatcggccggcgaaggaaatccgtggtattaacgatgctatcaatttgagtgagatactaatttacaaacccccctaagagacttcgctgcgttgagtaaaataaaataaagagaacaattgacgtagcggcctgatcacggccaggctaccaaataatgcggggagggggatgtagaaaaagccatatcatatgagtaaatgtgggaaacttgtgaataccacgtcttaaccccggactcccgaatcttctatcccccacgcgccaaagcaaaccacctatattccgctggagccgggagcctcctggtcttttcggaggtcgatcaacaattcacggaaacgctccttgccggagccgctggcaccgcccgcggagcccttgcccgatacatcaaccagcttagcaatgcgctcccagctagtgccacccgcagaggtatcctcccggttcgcgaggaactgttcggcctcggcgcgggcgtgggagcggttcttatcggccttgttgttgtaggaaacgtagaagtcgtcaatatcctcttgtgccttcttgacggtactggccttcttctcggcggagacctctgcacggcgggcgatctcagaatcacgcttctcgcgccattcactgaggatggaaaaacagacgttagcttgggaaccagagccgaaacaagatgaatgcaaatcgcaaaggcaatgcgccccgtcattcagagcctgagatccaactcaccgaacagcatctccctcatcctcaggttcctgcgcgctctggtatccggtgcgggggaaaggtgagccggagccagtgattgtgccaccgggagcaacgcgctgcatagatgtaacccctggtcagcatactgtatgttcaccacaatgtatccaatagccaattcatacctcattctggttctgtgtcgcaacggaggggaaggatgattcaaattggccaatttcctcaatgggctcatcacctccgccgagaaggtcgtcatccatcgtgcctacattggcgccggcaacgtggtcttgagaagtagcgaattgctcggcatcttcaccgagcgcggcacgctcacgggcaaggaaatcatcatcggtggtggcttggacgtcagctacttcggtttggcctaaatgcgggtcatgttagctccggtgtaaggagagcaagtaaggtgggttgagcataccctcagagaagtcctctagggaagggaaacggtcagccatgctgggaatggattgtacttgactgttgtatgattcaataaagacgtttgaatcaaggagatggtcttgagaagaagtaatcaaagggtcaggaagttgattgttataggaagcagtgttgacaggtgtggccggggcgggctcggaggcccgttgttctgccggttccggggcggtaagcttatccatgtttcaagctttggggtacagaccacttcaacttcacttgtggtgaagaagattgagagttgagatcttcgtttgatatcccttttgctttgttctggtggcttttcttgattgcaacttagctgcagttttaaatcccaccggtgatcttcaatcgctcctcgtttcctatttgctttcacagtgattgcgacttgcacttcagatccgataatttcacttctcaagagcttgctgcttaattcaagtgcttactatttctatcattatggcttttactgatgacgctgtcaaagcaaagctatcagctctgaacgacacgcaggagagcatcgttactgttgcgcaatgggtcatgttccacaggtacagacgcttactccaatctcaaagagacttgctaatttttgactgtaaatttagacgccatgctgaacggactggacaaatttggcttcaaaagattcgcgaatcgccgcctcccaagcgactcaacttgatctacctagctaatggtatacatatcctcccacacccgagctccgctctgcttgctgatcatatacacagaggttgcccagcaatcgaaagtacgcggaaaacatgatttccttattgcgttatccccagtccgtctccctaccggtccggcattgcaactcaaactaacagaacaatagataattgtcgacgctacgtcagcggcttacaagggttcgccgggtgaatatcaacaaaggatccgccgggtcgtggaggtctggagacaacgcagtgtattcgatggtcctattttggatgcagtggaagctcgtatagacggtaggtcggatcaatacgcacgagtgactagccaaactgatcatgttacagaactcgacaaagctcgtcccacaaacaagaaacaaaccctcggaggatctttcttcaaggacacttcttcgggatccaccccgtccgaactacagcctctcaacccattgcaggttactctcaacaaggctgtcatcaactccaccaactccgccacaagcgctacttcggagttcaataagcttcacgactccaagacaccgaagcctacgctgcctgtacacgccgcgcgtctaagttcactcttgaagacgcttgccaacgcagaaaactccgtctctgaggtaatcaagtcgcgccgcgccttgatcgatgggcttgagaagattctccagaccaaccgtgcggagctatcgaaggaggaaggccttagcaccgagatcgcgcagaagaaagcctcagtcgataccgagaagcgcgaagtcgaagatgcgattatgcgcggtctacccagcgaagagtcctctacaaaccccggcgaacacagcggacacggtgatgcatccgtccgcccagaagtcgaagctctgacacctcccccggtggaagctattacgccggtggggtccccacagccagaaaagcagcagcttcgccgcggcccgtttacggaagaggcggacgaggacacttcagaatggaaccccatgaacatccccgatatgcagcagtcaggcaacgggtctaccatcattgataagcccactaccacttcttcgagtcatggcaatgactttaatgtcgctgccgatggtcatgcaaagaggcgcaagatctcgcatggcgaggaggactatgcggcttttgcggccggcgagctagatgctgatgttgccgatctgcttgccactcaggcaaacagtaagtgagcttgaagcataatggtcgaggccagattttaccttggtggtttatgtgcgtcggcttctcttgttttggtgtgatttattcatttctttcttattctatcgatttcttcttgggcattatttcggtttatgctagatatcatacttttgtgtatgaagtaactaaatgtatgagttggaccatgtaatatatggcatttatcagactcgtagtccgattctctccggattttctccgtgccagtgtcttgcatggtgtctagtgtctccatatacatcgtgtttacgtgcctatttgcttgcgactagaactaagcaatacagcaactatcgatatgcaacggggatgtctgctcttctcgtcacattaactatgaacccattctatttgcaaaagaaatgtcatcggaatatatccggatccatccaccgatctcgcgcgaagcggttcgacaactgatgccttcgcccccggtaagacaacacagagcggatattgtttgaagattcatcttctggaggtggtggcggctttgaactgccccccttcggtttcacgaccagtaaaatgatcatacccaccacgacaaggagaagtaatagcatgatcttacgcttagtggttcgttgttgataacccgtagcctatatgagtcagtttctcattctagcgacattgaatgaaaagaaaagaaaagaaaggtaacataccactttcagctccttgtccgcagccttcacctcggtgcccattcgctcgacgttgtaatctatacggtctaacatggttccttggtcgataatcatggtctgcagttcacggaaaatatccgagagttcaataatgccctttgcgatatcgttgatctcgcgctcccgctgcgcaatagcagcatcattctgaccggtctgccgttgcgaagtctcctgcaacatcgtctgcgaaaaggacctgtcggcatctgactccatcatcgacggatccgtgtatgggttctgggcctgcgtaggcgcgccgtcgaacggcgtcgcgataccctcgagatctcgcaattctgcacagaaacaaatcatcgcattagcatatttgaaccaaccgattccgcctgtgccacggaaagagaacaacaagaacgaaacaaaaagaaagaagtggtcccatactccgtaaataagtactttgcttcttcctaaacctagcactggcctcctgcaccctcgcagcaagcgaaatctgaatatttttcgccatagtctcctccccactcgtaacaccaccatgcgccttagactcgccgaccatagtctcgatgcgcatgatagagcgctggcaatcatgaaaggagcgcgtgacatcctgcgtcaagctctcgataacgccctcgtcctgcctgcgcagctcctcgtcgccgaagccggggagaaggtgtttctggtgtagcttgtcgagctgggcggagttctgggcgatctcggacaacagctcggagacctcttcctgcacgtccacccagcgcggcgggaggaggtccatctcgatgaccatgtcgccatcttcgtccgtttcgggtattaggcgcctgttttcctccgggtgcgagggtgtgtcggagaagccatttgttggtgtgaagtgtggctttttggctgggtggtggatgagggattggcggtaggagaagtagctatgtttggaggtggagtgttagttgttgttatgatttgtaggttggtcttgtgggtggtgtttcttttcttttctggctctttcccggcgctgacgggttgcgcttggggtagggtagggtatatggggttgcatacaggttggttcgatcccgccacattgtgagggcgtccggaggatcgagttgtgtggctgatttattagtttgttgaggttataggaatcatgatcaggtgggagtgttaggctgggattgaatggtttagagtctcgatgtagccagaagttgataggagctctccacatgtcggaaggggtcacgtatggtattcatcatgtaatatgtggttttgtccacgtggaatgtggtaattttggtatggctgggtaagatctaaagacagcttgatttgcacatattctctactataaatataccgatgtctctctcatgccagcccctaggtagcttcaaatggcttactatatggctcgtgtgctttaactaaaagtggcattgacagtggacccccggattttcgagcacaatatggcccaaataggtaactatatgcatccatggatgttctcaaggtaatgcaaattcgaagactaatagactggagaataaccgaacaactatgtttcattgatatagggtattataatatgtcttatagtcagcttggttccaggcctataaatacacccgcaggtctacaccctacaaagtactagatatagccttggaaaagagatccaagataaaacacaagccaagaccttcctaatgcaattagagcaatcaaatcccattgtctattctggtatagtatcactgttagctcgatcataatagccctgggccacgggatcaagctttcttgtccggcgttacatccacatcatacaagatgaggaaggaaatatataagatagtacttttcaaaagattgaaaaggtatatccacatgtacagagtagatctaatgagatatcaagagataacagaagaaaaaagaaataccaatgcatatgcccagccagtggcaacattcagccccaggagagtcccaccgccctgagacgaaacgacgctgactgggcacctcagacacgctattttggttactctcgtaaggctgctccccttaaccctcttcttcatttgacccctccttactttgttgtattttccacctacattcatcatggtatgtccatgatccccctgacttatcagttgtgttgtcgaaaataatcgacaacaaaaccccccacattgcggggcatcgtccctgctgaacctccctgaccatcgtattctctaggccgattccctcaccgaagagcaagtttctgagtacaaggaggccttctccctgtttgtgagtgaccacacacacacattgaagatgtgatcatcgaatacatgctgaccggggtttgttttgttgcgaaataggacaaggatggcgatggtacgtgtggtcgcgcccgacacagcttagtcgagcccacagcagggtcctcggcgatggaatctcgagagaaaagaaaacattctaacatgcaatcctacgaatagggcaaatcaccaccaaggaacttggcacagtcatgcgctcgctgggtcagaacccctccgagtccgaattgcaggatatgatcaacgaggttgatgccgacaacaacggcactattgacttccccggtacttcaccataatctactggtataaacgagagacggctactgacgtgcggtagaattccttacaatgatggctcgtaagatgaaggataccgattccgaggaggagatccgcgaggcattcaaggtcttcgatcgcgataacaacgggttcatttccgccgccgagcttcgccacgtcatgacttccatcggcgagaagctgaccgacgacgaggtggacgagatgatccgcgaggcggaccaggatggtgatggccggatcgactgtatgttttggaaacaatcttggagcctacgggcacttgcctccccaaatgctaacctctccgtctccatatagacaacgagttcgttcagctcatgatgcaaaaataaacgccgcgttcccaccgtgcgcctttttcaatgttagctgacgtcgcggttttttaacgagaatgtttctcttccatttcaattttccaataccgatttcctgtagtctatactcactaggctatacattttggatgatttacgatcaagcgtgtgctttgaaatgcagacggagtggactgggcggtacattgggtcaagtgttcataatataggaatgatggctctctccctctccctataattctgatggtactgggctttcaacatcaccctgtgccaaccaaccatgtccatgtccacgaaataccgtagcaagcgtataagaagtaacctaaccattcatccataccaaagcccaccatttaagcatacagctatcgattaaacctcaaaacctccataaactgcctcgcaacatctgccccagaccacggatcagggtcatcctcagcacgctcaccaaagccagtcctatcaaccttagtatcagccccagacccagccttcttccacctcctcaaccgatccttgacctccctcccaacattcgggataagaatcgcctcccgagcctcaacacccaacctcccccaaaactcccgaatcagcgatgcagtagccgcatactcagcatcgatatccgactcttcaatcgcagagctagcgaggtcaatacctgcgacttcaacgtccacatcacaaccaccgccagcaccaacatcaaacgatccatcctcccgatccacaggaatggcctccacaaccgacggaccacgccactcaatctcaacaactgtgccacgcacacgcgccgtcgggaacgtctgtcgcacgtcaccaagacgcacgcggaagtcaccaacctcatagacgatcccgttcgggacagctagcgtgaaccggtggttccagaagggctggcaagcgtaggtgaagtgctggaagagggtcccatatgacgaaggggggatagtcgtcataaccattggcggggtggaggagtgatctggcgcgatggcatttacagggccgcgcgcgccttggttttgattctggtttggtgctgggatgggcttctctggctccgaggtgtagatgaaaccgtgggctgggtagtgggttaatgagagaaattgcatgtagcgtgggtttgagggtttcttgtttgagtttgaagaggggagtaggccttgggtgtcgcggaggagcttttgctcgaggccccagcggccgattggagttagttcttcatttgggaaagcggcgcggaggcgctctgtaattacttggagggctgttgaggcgtttgggtttgaggggatgaagtagacacttagttgggttagtttgggggtttgtgttggatttgaagaggggatttacccagtgataggcatttttatgtttgttttcttcttatattctgggcaggtgcagaagagatggaactgatgatcacagcagtgttgagctgagagatatcgattggggaactgatgtgttgagaagatggcggtgatcagcccctagacagtcttcagtcctactagaggattgattcaagagatctgtagcaggtagcgaccatgcaatatagatatagagattgatcaataagaatgatgatcaagtccagtgccagaaggaatgacaaaggacgattcctaaacaggaagggagctttgcaatctatatagcttgattagtataaacactgattgtgagaagaatccgttacctttggacaatttctatgtatatgagattgttctggaggatcaagtggtcaccagatgaaagcccacgatataacactggagtgcaaacagagcaaacatcttaacacttcaactgtctggaaaccaaatctttttcttgcaacgataattgcccttttgttatattcatttccctttctattacatggtattgcaattagagaattcagatattcagaatgctgcttcctttcccccctctttagcccgcaaagagattgatatggctcgaaagtgcccgaggtcagccttgcggtcacattcagctcagcttctcgacttcttgatactagtccctttgactccactcccaaagcacaaaatggtgcatatgaacggcttcctatcgatgtgacatgaagacacaagcaggctttcagacttgcaacttgttactgcttcccgatcttcatctaaatatcgacaagatcaacacctactccatcagagagagtcaggggccgcagtggggttggtggcgccctcagacagagtacagcttagaggcacagaagagcctcttggcgcttttatcacaagtctagacttgaccattgatacactaataataacattatgttgtttggaccctgcggatttccctgattgcgtggcccggtgttgaagggggcacattctcaaatttgcgccaatcatcgtccgacgctctgcaacatcatgccttgcaccaaatcgacagccacaaggacgatcaatggagctccaaagaactcggccgtgtctgactccttgagacctctcacaatccatgacgtgccacattgtgtaaaactgtgtccatttcctcttttgcttgttctaactgtcgcgaatcttattctcctggagacgccaatgtcggcctttgctactagtccctacacttgacaattgacttgtacaccattcaactccttctctgggcttcctacgactatttccttttttttttttttttttttccttttttttggttattttggcacgcccctactgcattcatttattatgtataacaagcgcaaaaaccgacctttatcaacagcattgtttgtgattatcgcgacatacattttcttcttctggctccctagtacaaaaacatatcgaggtcgcctagcaaagccagtctccagaaaagacagcaccgttcggcaagatgctattcgtctagataaagtcaccgagcgatttcccgttacagagtacatcccattgccaacaagcccagctaatattccccgcatccagcataacttccccgaagaaacgcgcggcgagcgcaatgccagactcaagaagcgggatgctgtgaaggaggcttttcttcattcatggaatggatataaggaccatgcgtggatgcgggacgaggtgaaaccccgcactggaggataccaggataccttcaatggctggggtgccactcttgtcgattcgctagatgcgcttgtgatcatggggctagacgatgagttgcaactggccctggaggctctggaggaaatcgatttcacgacgactaagagcagacatgtgcctgtctttgagatcatcattcgctatatgggtggttttattgctgctcatgacctgaccgagggcaaacatcctatcctgctgagaaaggctgtcgaactgggcgagatgatcttcaatgcgtttgatacgcataatcgcatgccccaggtacgctgggagtggactaggtacgccacaatattaaagaatatgcaacgatattcgggactgacaatacccagatccgcccaaggcaaagaaatcacaccatcctcacgcacgagcttagcagaaatgggctccttgacaatggagttcactcgcttgacccaattgaccggtgatcccaagtactacgacgccgtgcagcgaattatgaacgagctcgagatcggacaagacaagacccggatgccgggcatgtggccgacatggattgacaccgaccgaatgacgttcgacgactccgagttcactattggcggatgtgccgattcggcatacgagtacttgcccaaagaacacattctcctgggcgcacagacagacaaatatcaccgcatgtacgaaaaggccattgaaacattcaacgagaatctactgttcaggggaatgacccaggacgaggaccaacacgttctcttcacagctaacgttgttgcaatgcggggtgactcgaagaccttccagtatgcgcctgatcacctcaagtgcttcatgggcggcactgtggctattggggccaaggtcttcaatcgaccggaggatatgtatgttgcccggggacttaccgacggctgtgtctgggcatatgatgttatgcctacagggattatgccggaagtgttcaaggtcagtccttgtaagcacattgacgagtgtccgtgggatgaagagcagtggatgtcagatgtcatatcgcgctctatcagtaccgaggaggaccgcgagaaagcggaggaccatattgaggctgagcatttgccgcctggcgttactagtgttcgagacgcatcgtataagctcaggtacggtttcatctcattccttctgctgcactttactaacatactacccttctagacctgaagctcttgaatctctgttcgtcatgtaccggattactggagataagactcttcaggactccgcgtggcgcatgtttaagaacattgataaggcaacccggactaagtttggccattcgtctatcaacgatgtgcgtcattcgaaaccaaaacatcaggacaaaatggagagcttttggcttgccgagactttgaaatacctctaccttatcttttctgagccagatcatatcagtctggacgactatgtgctgtatgtttgctccccagctgtgtttatcctatatgaacgagctaataattctcttttcaggagcacggaagcccatcctttcaagcgaccaagcaactgaagcgttataatattgggatacagctttcatcaccagcataatattggtttgactcgacaggaccggcgttacaggcattagggttttcaatatcatatacagcatctatttcttccccatctaccagagcaaaggatgcatccctggagccctatcccatatcctacatccacacatgacaccagaagccttaatataaaacaaaaattatacataagcacagacatcaacagaattaatcttcaaatcctcccgcctcctcacctccgcctcatcttcatattgaatcgagtaccgaatctccttatgaataaccatcttatcaggcccctccccatcatccactcgctcagtcgcaccactcgcatgccggttatgcggcctcggtacaagctcgatcaaatcagattctgtcgcaaatgaacccacagacccagccctcgcgccattcttccccttctcctgtacctgaaagcccagatttttgcgcggtgcgctgagcgggaacatcgaccgacgtacaggctcacgcaccgtatccgatctgccactcttcgcatcctttcggtttttcccaagcgctccgtgcgcacggggactggtatcaacacacaacgaagggtccaggcgggggcgctgattctccgactgttgcagcccagagctagaaccagggccactaacggccggagtaactagcggtggctttgaacctgtcccggctcttttcctctgtatgcgggactgcgacatggacctcgaagcggtattcgaattcgagccggacccggacccagacccggtcttcgagctttctttcgtaccgtttgatctcgacgcgctattctctagcgtcgagtcgcccgctgtaccgtagtttgtgctgacggctgccatgaaaggtcggagacagaatacgctgcatgcgactagggcgtagtgaagctcgacttgcatccagattgttggtttgacggcggcgagggttgtgtctttgttgtttagggctgcgtggagggatgagatgtggattagggagaaaattatgagactggcattttgcggttagccttggggttgagattggggatgcgtgttttactcacggaaagcgaaatataaatgcaaatccgacggctaatttgcggcgaacggacataaacagaccttttaggaggatcacggcgagaaggaagaggaggagctcggttataacgtcgactgcggcgatgaattgccatcgtatgtactacacttgcgagattagagacggcctcagggaagtcgatgcatatagtatatcattggtggtttcacataccaagtcgctgcattcgccgccgtcactccgccaaggtgtgtttagctcacagttgactaagacgatgaatatagccgggattacccaggcagtgcacagagctagtgtcgcccaggatgcacggttatgtggtttctgcggtgtgaggcggaggtagatagccacgacgcagcatttggagaggtagatgattatgagagcgatgatatcgcttgttgcaattaacttaggtagctgctcagtttgggtccatgcaaacaagataatagaatatcaaatagcgacttacagcttggatctgatcgagtcgaccatccttcaataacgatatagaagtcccgaacccgcgcgagcaggcatagaagacgagacttgattgcaccacggcgacagcctgtacagcaatcaataatacatgttagcagtgtactaaggtaactcatccggcccaaatttgactcgaattttcgaggcaactcaccgtagcacccaacaaaacccaatcatcgcgcgcaaacggcggtatcagcatgagccgcacatataaccgaattaagaaacacaccaaggacacaaccagtcccagtgcagcagtgataattacccacgcgccatggtgcaagtcatcgacaacctcaaagggcggcgactggcctggcggcacatacgggcccatgacaggggaagggagcaaaagccaccgcaaacgacggagtctaaacaagtacccttctcgttgttatggtgtatatcatgtggaaggatgggtataatgtggtgctatgtggaatgtatatatgggccgcggtgatcaacacagacacagaaacgactgtgaaaggctgtcagatccgggagccatgtggctggatggcgtggtgagaataagttaaagaaagggtttatttgagacgcttgtatacgatagaaaaacaggagtaggagatatgcgggtcaaggagaggcgataacgaccgagctaggttccgtttctcctacgattcgcttgcgattgcgattatttctgtcttgggagaccatatgctgatatccgatacgaaacatggattatcgagtccagacatgtacgtaagtacggagtagggctggtggggttcgcccgatatgggcagatatgttggaagggggattcgaatttgcatggccggtttatccctttcttcttgaagggtataagcggtcattattttcggtgtaagttcaggttgtctggttggaatggtgattgacctctctccctcacgtcgaacttcgacgtagtacggagtactccgtactgtggacatgctactttagggcaaggcgggcccgctgtagggtcgtcgatcagcgtgcgcccttgaaaattatgctgtgggtctttgggggggttcgcatcctataggctgtgggatttgtttttggacgaataaagcgaggggcttatgcattcacccgttatttggatggaggcaagcatggagtgtggcggaattgtctgggggataagcaacgaggggatgtgggacagggattgatagagagttagaaagttagcgcaattgatgcatcagaaatgtaacgggtagtggcgccgagtctattcaaggggtcaggttttgtttatatttcgtacttggtgtgttgttttattattttgttgggtgcgctctttaaagaaacaagtcatggtttatacaactacgacggactagaaggatttagagtagcattacaaccccaatagtcagtctgaattccaatatctcccaagtttaacgacattaaatggacaaaccccctgtggcatgcaaggtgccatcacgccccattccgggcaagggactagggatagcaaactgcaaaaatgagtcccgagagtcacattcccaattggattcgatgcagcacccttgagtaaagaacgatgtatcattcggatcgttgcttgggtgttccgaggaggccttctctcccacatggcgtgtgagaattattcacaggccatgccttgcgcccacgtcaataccacgcttcggtcccggcaattcagtggccatcatgattccagtcctttgggtcttctcctgataactgccttttctggctacagccatttctgttagctttattagaggttgctttgatcgttcggcgcttttatacttcgcatcctacatccttcagggtgtcgagttgccaggggatatagactttcttttctattctcgcaatccccttttttttcgcggagaattttgttgtctcatcctgaatagatttttccaatctagtcattcagacacacacgcgatcatgacggtcttcagcaggtccagacctgactcgcagcagacgatgactggtcttgacgacgaggagtatgctcaaaaaggccttgttgagccgcgttatatgggcacgttggcggatcgtcgtgatatgaatgctcttggtcgagtccaggttctgcgagtaagttgctctgctcttgtcatggcggttgtggcggtcttgctaacattaggaagagaaactttcggtttatctctattgttggatttggatgcactttgatctgcacatgggaagttatcttgacgtacgtgccagtccctgcatatggtgatcatgcagacctctgactccattaatagattgctggcggctggcttgaccgacggcggtacagcgggcttgatatgggggttcatcggcgtctcatgcggatttacccttgtctatgccagcattgctgagatggcctcgatgtatgtgactgacggcatgctgtccctggctggatccccgctaatcagtcgacaaatagggcccccactgccggtggacagtatcattgggtgtcggagttcgcaccaaggagaggacaaaagtacctcagctatatcacaggtaatacagttgacatagctagtccttgtgtaagtctagctagctaatgtattatcttaggatggctttctgcaatgggttggcaatgcgctattgtgtccatcgcctaccttgctggcacaatcattcaaggcctgatcgtcttgaaccggccagattatgacttccagcgatggcatggcaccatgctagtaattgccatctcgacattctcgatcttgttcaacaccttcctagccaagaatcttcccttcgtggaaggattgatcttgattatccatgttattggcctgttcgccatcatcatcccgttatgggtactcgcaccgcgggataatgcccacgcagtgttcaccacgttcaacaacgggggtggctggaacaatgctgggacggcaacattagtcggtttgtctactaccataacctccatgcttggttacgattgctcggttcatatgtgtaagaaagagccctatgaacgacctcagacctggtatattgtgctgatattcaaaagccgaagaaatcaaagacgcatcagagacactcccaaaggcaatgatgtcctctgtcgccgtcaatggtgtgctaggattcatcatgctagtcacattgtgcttcacactaggcgaggtcgacaaaatcctggatacaccgacgggattcccattcatccagatattctacaacaccacaggtagcatcgccgcgacaaacgccatgaccgctgtgctagtggtgaccctgacagctagcacaatcaccgaggtggcgacggcatcacgccagctctggtcgtttgcacgggacgaggggctgcccttttcgtccttttttgcatatgtaagtccccgatttaatccctgtgtggcatctgaaacaagatgtgtagattcagccatattaatccgtaaccactaggtcacacccggctggaacatccccctcaactccgtgatggtgtctctagtcatcacagtgctactatcgatgattaacatcgggtcggaggtcgccctgaacgccgttatctcgctcacgatcacatctttattgtccgcgtacatcatctcgatcgggtgcgtatttctaaaacgcattcgtggcgagccgctcccgcaccaccggtggtcgcttggaaaatttggcatggcagtgaatatcggggcattggcgttcctctgtccgatttttgtcttcgcgttctttcccctgtcgacggatgttacggttgaaacgatgaactggagcgtggcgatgtatgttggcatcgttggatccgcgacgatttactatttggtttgggggagacatcattttattccgcctgtggctttggttcagcgggatgaaaatagttgaggattgcctctggctcgaagggtttgtcgtttcttctctctctctccctttttcttttctttttttttttttttcctgttattattttcctgtctatgtttgactgcattgtgtattttgtattttgatgacgtgatgatgtgacatactcggtgtataggtataatgttgagattctgctgctattatttatttgagtatcactattttgtccttttcaaacaggactccctactccgtacattgtacaataatgacgtggcctcacccctattagtggtgatagttactcgatttagagacttctaagcacaaaggctcgaccattcagctggccatcggcactgaaatttaagttatcagatagaactgtttcttcctcctatgacacaagcgcttcatgacctctgctactccgtgcgccaaaacctaagcttcttgttcggtctaacgaagatggtggatcagcaacacctaaaatgcagggccattgataaatagagatctagtgcacaagaaaagcccggagatgagctataagtggaggagccagcctcatgatatagggagtggtttcaggttatgagcgttattattaaatcattaaccagccaccaatgaaactttcgagctgaaagttccaggggtgatctgttttgtttactgtttttttctagaacacccctagttcattcaatctgactgattgattcctgacatccccactttggaccgaatggttgggaaatcgatttttacggagagttaaggacgtgtaagctaggagaaccgtgatgggtcaacgcgatacacactccggctaggcggaaagtgggggagtccgtagagttccatttggtattttataagaatgggggttgaaaccaggggaatttattttataagtataagtaccatatatgtactccgtaagtacccccttaactgggatttcccttctagatggatgtggagttatcagatgggattgattactcgatgaggactgagggagagatatttgaaaaagaaaaaaaaaggggaattgccggtcatgtctgaccgcttcatgttaccgcctttgacaagcgggttgactcctccttcccatcctcattcgtattctttccatagggaattaagccatctgcagttcatcatttccatcagtaaactgtcttttccatcaagaattcatcagtcctaggccgtctgaagtcatatccatcaacctcggaccgaaggatcaccagtagactgtctgacggaggtggtgaggcctgcagagggtgcaggccaagatccggtctgtcaaggacaaatcccgcctatctgattgatctgataaccgaggtaatatgtatggtattgtcatgttaccaaacttaccaacattttctgccggcccacctcggaacatccattttctttccaattgcaatttaaaatatccctgtaaaacccctgtcacaacgtaaattgtatattgtaggatagtctcaattgcaatcatacgatattattactgtggtcagtccagatcaacagccgggactctcctcggctgttcccagcaccgaatacgggtaaggtacaaggtcatcttcatatgcaccgtcgatccggatggatatgatgaccccaaatggagcctttgccatatccagtagtcgagtccttattactactgactttcaagatctacataagaccatatcccatatcccatattccagctcttatatttgtgtaaaatatcaatgccggaaccaaccgcgtaacgtaccccgtgacgaagaatgtggcaaatctgataaatccctgtactgtttccgaccttcctgtgagatcccgtatttctcattcccataccgtcattttcactttcccggttccctgtacggaactatcgccccgaccattcttcgggtccgcgttctcctccctcatcccactcttctattcccatgctctattcatagaaagcaaaaaaaaaaggggggctttattacgtcccttaaccagtatcacgtctcgactcatataccccggtcttccctcgttgcgccgattcttgtgcaacttttcggcgactcccaacactcctctaaatttcctcatgggtatgcggagagcactcaatcccaattatttaaccttttgagacttagattctgatctatcgaattagttcacgccgttcaacctatcatgccatcggcgacttactctacggggtcccgtccccgcagaggcacttaccaagaaatcccagtgtcctcgacctcccacccagataacccaattccggaagagcctcgaggtgtgcgttcgctctcagtaaccgataccaatttcaacgtcatttcctcaggctcctcccagggcactgtatcgagcggctcaaattcccccgatacccctctaacaccacccaccgagtcccaatccgaggaagaaaatgcagaggaaaaggtcgacggtggtcggcaacgacgacgagcatccactgtcctcatctcgcagaacgcggttgatatgcgaagggtattggagaatgtgggcacagcaggcactcagaagcttcagtctctctgctgtggtgggggttgttgccggggacaggcattgcgccctgtagatggaccgatctcaggcttcaattccatcgttgcacctatcggcaacaaggcattcgatagcctcaagctgaaccttgacctcctcaccatggatagtgagctttccaacattgccccgctcccagagaagaccgtttcgttcaagccgcctcccgcatcagcagccgacttgacctttggccctgcagaccatccgccggaattcgtgcagccacaccccccttaccaggtttaccgtgcgcctctgttccacacccgtgagttgacaggacccggagccgagaagcgtacctaccactttgatatcgatgtcaccgactaccccgccgaaagcgggatggtcgacttcgtagtcggcggtgcaattggcgtgtgccccaaaaacaaagactccgaagttgaagaggtcctcaacctcctaggtgttccgaagtctatgcgcgacaagaaagtcctcatgcgcacaactaagggccgctggccgacaatctggggtgatgacaagccgcgcgaactcatcactactcgtcgcgaagttctaagctggtgctccgacatccagagttacgccccaacaaaaccactcttccgcctcctcgccgagtacacaagcgagccaaacgagaagaaaatcctcgaatacctctcctcagcccaaggccaaggcgccttctgcgacctacgcacaagctctttcgtctccctcacccaactcctaaccgccttctcaagctctcaaccacccctcgatcacctcctctccgtcctcaacaccctgatgccccgcttctactccctgtcccaagacccccagatctcctgccaatacaaaggcaccgaatgccgacgcttaattgaagtcgccgtcacagttgcagaatccgctgactggcgcggtgggacccgcacaggcgtaggatctggatacctggagtccctcgcgcggcgagcgattgccgcagaagcctccggcgaaaaactggacctccacgtgcccatgttccgaggactgatggcgaaccctctcgcaacgcgctttgcctcagatggtccgatgctgctcatcggcgctggcgttggcatcgcacctttccgcggcttcgtgcagcgccgtctgcagtcggcgaactgcgccaataaggtctgggtgctgcaaggcgtgcgggactcgctgctcgacgagctttactccggcgagtggggcgtgcatgaggataaggtgcgcactgttgtgcagagccgtaggggcgagagtcgctatgtgcaggaagaggttagacaccaggctgacctcgtttggttcgttatcaactcgcttgatggtcgtgtctttgtttgtggttcgggtaagggtatgggtgaaggtgttgaggctgctctcattgatgttgctatggcaaagggtaatctcaatgctcaagaggccgatatgttctggcagcggaagaaggaggccggacagtatattgctgtaagttttgatatgttttgatgtcttgggggtctatactgactattttcaaggaaacttggtgatcacttaaattctaagtgccttgacgcattgcgccttgatggttaaatgctcattcatgtgcaaaaagacatcattgttccttcgtctgtacatatttgtcccatcctgcctgcatctgcaaagctctgcggttgttctttcttttgcttcagcttatggctagatacactcggtcaggtcgtcgactggccttctctcgttttgctctttgtctgattcatgttcttttagcggggcggttatttgttctctcttgtcttttttctccttttgcattctttatttctcgggcttatggttgttatctctttcattttagttgggatatgcataaatcaatctttgtttctatctgattgttcttcttgacgaattcttcgcaccatatcccggaattatcacggcggattcgctgcttggtcttgtccgtctacttcacagcaatctcagatgccgaacccaatcacaaaacgacatgatgcactccgaaatagaaaactatcctatatggaaagggaatcgactacgcataccattttttgatcttgctttattttcactgttacggttatccctggccctctgaaccattgatccctctcctacttccatcaacctaccgcctatatctatgaagctgctcatcggccccggggttctcacttggttacctaagtcgcccttgatattcagtgttggtctctgtatattaatttgattttgatactacggaactgatctcattacggaaccatggccatggttgcctttgtcagcactagacaacagagctcggcaatttggttggtacaaatcaagaccggccataccatttgcagctccatagcctcgcgaaggatcagctgactttcaatcaacctggctaagcactaaatagggaaaaggcacagacaaggtccacaaaccgcgcggtattagacccagaggcgttgcgatgagatcgccgcgacgatgtcaccgttgatctgttctgttctgggaacctatttattcatcccagtctgaacttgttcccccttttcatcctattctctctaatcctatctatatcatggagtcctaaccaccctaccctattattccatcaggcagtgccatgtcgactaagcatcgggccactatcttgggctgcccaatctgattgcctgttatttcccgtctttccaactttatattcgaccagtttgtgctagagaaggaacagcctcacgtcataacccaaacagaaactactaggcaatcgtcacggtcggaaacttgaagtgcaacgcacagccttatattcgcacaacagtggtgacctaggtatcactcagcaaaagatcagggtaataaatcacccatccatctatctatgcatcatccatcgtccaccaaataagaacaagaaacactgttgttggagcgatcgaatcagatttaccccaaagtgctaggacataaaccaaacataacttgaagatacacatgctgcagtcaattgtgtgctcgaggtaattcatcaggacattcttcagtcgactttcaggtaaaacaagaacggcggacgcaaagggttaacaagcaaagcactagagcatggcaacaaccaccacaacggcagctgcccccattggcgcagcagtagccatagcagctcccgcattgggagtctgggttgcctggctggcagtgaacgaagccgttcctgctgtgacatcgatcccgtaggaggtgtaggacttcgttggcaggttcgtggtggaggtggaggtggaggtagagtacgaaacgccagcggtggtgccagtgactttcacgctaaacgaacaggaaggagactgggtggccttcgcgaaagtgcaatcaaagttctgggttccagtcacagcattgactgatcccgagcctgatgcggtatatacaccagtgagactgtaggtgcttgggccctggatcatggtccagggagtagcgatttcgcaatcagacttgggcgcatcgctcagacatctgatttcgtaggtggtggcgatggcattgatcccagcgacgctggcagccgtgctggtccatgggtggaggctgagtgaatgagcccattgcattccaccgccgaagtagttgattctggttgattcgtccgcagtgacgagggcagctagtgccgttgagagaaaccaactggtacgcattatgtatttcgttttgtctttcaaggttgaactgttagagcaactgatgagagattatgggatcaagaaagagaaagggaccaagtggaaacggttcctcttttaagtggcattcctcaaactatcagaggccggcccccgtatgaattcagcccagcaaatgagctgaaacattgcaggctaactatgcaactaagcaaagcgagagagtctcattggtttggctgtaaagggacgtgcgtagggcacccgatcagagccggatcaaccgctgtagcctaattgatggtggtggtgcagatgcactagacaagccaccatttgatacgcgccctttgaacaaagatattggggaaactgactgcaaaacccatgaagtccctcgataggtttccatcttgggggcgtgattagaggatcgagccccttgggggccgtttcacaagttctcactcctgtatcaggttggggccgccccaatcgagcagtggaagcataatgcatctcgacgacggaacaggaactttatgcactgataatgtatgtgctgttcttcgatttctatcggagaagacagaaatagcggcaattatgatctacggcatgggtggatgaatttctgtggagaaggtaagttgggagaaaacccgtagactggattgagtgagactaggagagagaaagagaggaagaacgatctaggtaaggagtaatgtgctatccaccttatacagtatgtttcctcggcaatttctagatacttttgcaatctctagaccgctactccgccgagaaaccgaccagagctgtttgagcgagcggaaactgttaaaacaggtgcctagtcaggcagtggggattggtatatatacctgatagttcaggccggtatactaactagttaactaactaaataggagctcgtcttctttctctactaactatgagcagccgcatactttgccaacatattatttgccagcctcgctgttgtacttgtattcagtatgactgtcgcgtagtgtggaagtcacatatctgacagaggtatccctataagaaaatacgacattgtcgggttgtttgaatatcccattgatttagaaagctttcccttcgtgtaatatataagtgatgcatagcatatcaaaggtgcagtgtctgtggtatacttaggtagtgttagactcgagaaatagagttaagcatccaatgttcctccgcaggtgaaccatggtatgaaccccgttgcacttccgaagttctatggcttccatgacttcccttccaaggtttccaaggtttcttccggatatatcaggcagtcttggaaaggcggtatgtgagctattcatggctgcctagcctcgagatattgttccaagtaaccatcctgaatatcatccgcatttcttccctacctaggtgacaccccttactatcaaaatgtcagaagaagaaataaaccccgaactccttcccatcaccatttccgcaaacactcttaactccaagtcctaatgcttcacgtttcgatctcctttactccaccatcgaagccaccatccaagatgtgcaagcccgatctgagattgaccgtccggacttaattgtgattaccgatattacaacacaagagggtgaacacctctgggacatacttgaagaaaatttcgagtcgagagggatccgaaagaccctcgatacgcgtaacagaaccttgaaaatcaagctgtgagtctatggcagggaaaatggaaacatatatatcgcttttcaacgaggcgtttattgctacagaatgaaagactgaaggtccctattttaagttgcaagatcatgcggtgcttgctccaggttagagaaaaggccacgttagttatttgctgttcctaggccgacaataggattcccgaataggaattcagttgcttctttcttatcctctaactcctcgtctcccgcctccttattagaagcctaggagacgtcgacggcaatgatctccctttgttttgtgtgagcaactaacggcaaagaagcaaaactaggtaatatttcgctgattgttatttccctctgatgtgacacaaagacgctaaaccgacgtggaagcagcgcccttatagataatacaagacagacacaaagttcggaactgtcacaatactcgggaattcctgctgcaatctgattgcattcttattcggcgcctgatgcaagcggaataagttgagaaggcgattcgcttccttgagccataacccttcggtgtggaaaaggttaaagagaccacacaacatcaaaacgttgagcttgacaccaccctcggtgatacaattaacacaacgagggttgcctagatgggacgattacgctaacaaatatggatgtaatgccacgtttgtgcaaattcatgcttcttatgaataggaaacagtgtgagcagttgaattcaattcatgtttctctcgcttagtttggcatctaacccgttaaaccgcgtctttatttccactatattactcttagtgaatctccagcgctgaaatgtggatatatttcaaggagataccaaaactcccctcaggtgtgacttgttcagcatatgtgataagtgggctatgccgtcctcgccactccgtactcgtacatggccttccggttcgaaaatggagcgagtgacatttagggggatatatgcttatttatatccccaattttattgcattaggaagtagcaggaagtgatacttctgacgtctcacataggatcaaagtctttcctaatcgagcgagaaaacgttagatgtcggctctaaatttagccgtcgaggtagcaaagctccaacgagcagaaatcagacaaagaaacaaagtactatactatcgacacggtctttagcgccgagtcaggcactaatgcatagcccaccgaaccatcacccgagctcccgtcgctacacctttcatcatccagcaactcagatcactccataggggcaggaattccatttccgggccttgcctaactgcctaacccgttcaagaaagagacatctgacacccacccgcgtcatttaaaagacaaggccccatctaaaaataatataatatttgatctgaccaatagaggaaagaccctgtaatatcactttgcatggcgacgagggattggtggccttatcacgaactatacccttggcacacccgaatcatgcatgagtggtcctccggtgacacgagtctatgttgttttgggcagccaaataagcaaacaatccggattattgtccaaattctagccaggtacatacttaaaacgtgcacctatcaacgacctagacgtttaattcagggtggtttatgcagagggcccttttgggatgcccattgttgcatcattgtgtcactatgctatggagtggttacttgtgctagagccataagctgcagatcaacttattatttttaattatatgttttcctaatgacaattcctttctgatacccacatcgacagttgggggaaaaagaagaagaagaagaagaaccgggcctgcttttgacggttcacaaaaaggagacttgtattgattctagaaggaattcttggcaattcaatattataatagaccaaatagaagctcaaatgtcaggaaaatgaaaataaggttaaacacccaaaaattggatcgaaaaataaaataaaataatagtatataaaataaaatgtaaaatgtaaaatataaaatttggaataaaaagtaaattaaattaaaaataaaataaaatataataataataataaatattaaataaacccccggcagacccaagaaccgggaaatgaaaatgacaaatactgcaagtatccatggatcagtatgtgctcccaccgatctggagtaattcctccgacgctagggtttacaggccaaaactatatgacccctctctatttcccctctcatgactctggcttctttgagaggaccaatcattcgcattttggaccagtccattctccaagagacgatcctggttgcctgcgagatccgatgatctgcattccttcatgcacgatctctgatctcgtgaatgaggatctaagggcatggcaggtatgacgatcggatgaaaattccaatttctttttcacttttctctacgcagtttctttgttgaagtgtacgaagatcctcggtttgagagtttcatgaaataaatctttcaaattccgatttttcgaaccagatctccttagaacgacgaatcaaagacagtctcggtagatccaaagctccgaggctgactccattcgatcggaaataattttcggatttattttgaaggggatcttccattcgatcggaaataattttcggatttattttgaaggggatcttccattcgatgggtgggtcgacaatatgggcctaaaagacatactttagggcccgaggtgactgcgctgtacggagtaaagttcagttattaaactttgaagtacatagactcgggtgtcagatgaaggcgggttattataggggctatactatagggctgtacaggggaaagtcaacaattccaatatgatgatagtacatagacggatacttgtctcatcgtaccattgtgctccaggattcactaggaacctgtccaatcaccaaaaaattcagaaaaagggactccattgttccgacttgattggctgactagcgctaggctgaataagactcagctcgcatttatgtactccgtacgaagagtagtccagtgatctccagacatgacaggcttgtgccactattgaattgtcagaatgtgactagtttctagagcgggtctgttagtgcaatttgtgtcgtgtcaagctgagaaactgctccagaatataactagtggtccagattccatcgtctggacgcgatacgcgaggtaaagatgctaattagcgcaaatcactcaatttacggtcggcgaggttctgagctaagtacccaaaatgcaacacaactaagagatatcatatgcgagcgtatcttcaatccaatcatatcaatagccgcgatgttaccagttcacgagtgcattacgtcgtgacagcaggcgggaaaagaaaaaggaaaaaacgaaagcgggttctccgggtgatccttgatctgacatacaacatacaacatacggagacagaaaataaatttctaaaaaagaaaccagaaaaaaaaaaaaaagccttgggcgccacaagctctcgaaggaagtggagagatacaaattgaagaatcccttggtgatctatccctgtagaccaataccagcccctctccctttccatttggtcgatcaatcaccgtgcccaccgatgagaggctctaggcaatctacgatcgatccgagacgtcacctctgcggattctgattcgcccaaattaaatccagaacttttctgtcttttgtatccaccatccgggttaagctctcttcgtgacaactctccttggaagtggcgatcttttgtgattcggcgtctggaagatccactttggatagtctcttttttttggttttttaccatacgaggttctacatcttttagagttgacactctggttgtcttttcctcttccaccggagtgggtgtttcttcccttttgtcactattttgtcacgaactactccgtaccgagtactaaatcccgagtactgaatcatagatcccccacaggaaaaaagcaatatgggtgtgatttgatttaatatgtatttaacaactaattaactttagcctgactcaggcacatcatgacagaattcccccccctccttactcccctgtctgtcggacatcccctcttccccaacatttcctatgtactctctgtatattccctatgattgttcttttataaacatttacttttcaagtatactatactgtctggattcagtgtgatttcaaaggatcttgggagatctatcttttaggataattggaaatacttattggcttataagcactggcataggatcccctaatttgacgtacactagtgaatcacaccaggtttcccaaagagttattatattttcaattaccaaagaaccccgacgtcctttaccccgaagcatccaatcaaacccccctcctaaaatacaacggagtggttcgtaagatagatccgctaagactatttccataggaaccaaagactatatctgtcaaccttaaccattttctcttctccgctatgtatgcccttgacgcggagcccttggtgctccgactcaatgtacccactaagcccacgatcgtcatttttcggccccccctgttcttgctttcccatggacctgtaccagctggatctttttttattttattttatttttaatttactttaatgtagattttggggccacttttttttatggtagaaataatgtacggggccctgcattatttgggaaaccgcatttccatctttgccctcattccccaaccttgcatataatcttggcctttctcttttttattttaccatgtcaacgtaaaatcagcctgctttccctggtgagtgcttctttcggatactttcacccctcatctcctccctcttataccttttcctggagagtctcgaccttttgaactacagactcgtctgatattcgattctgactgtgtcgagtatagttcttattttgtaatacactgtgaaactatttccggacatttctactcttgtccctcccccgaataccttgtctatgtcacagtcccatgaggtagacgaagataccaatatggctatttcgtatacaacccagtcgccaaccggacaccctcaccaaaccctcccctcattccgcgaggtaagattatacccttcaatcctttcagaaatacgacctgaagtcaatatctaacatccctcagctgctccccgctcacctccacgatgaaatcgaatcaacatccccattctacaccaccccccgccactcgcaagaccgcccaccctcaggccacgaaatggccaacccccgctcaatcacatacgccaaccaaaccaaccaaattccctatgaatcccaccgtgaatacacagtctcccgcggcgcagaccaccaaccccgcatgccagacccaggccaccacatgcatctagccgaaaactcatcccgcgggcccagcccaattctccccccaatccgtgacctggactccattcctggtcgagcaatgaacccggcctccagcagcgggtattccgagcgccccccacgctccgacccctttgttgcacaggaataccgccagcctgcgccgactgcagcaatgtccgctgatccgcgtggcgagcactttgcccagcccatcatgcatccccagtcgccatatggacaccctggtatggcgtatgcggatgagcagatgtcgccgcagataatgggacacgggcagggaaatttcggcattatgggtgacccaattgatcctaagacgaagcggagacgggggaatctacccaagcctgttacagatatcttgcgggcttggttccatgagcatcttgatcacccttatcccagtgaggaggataagcagatgtttatgacgaggacggggctttcgattagtcaggtgagcatgtttgaaactggagactggcgactgagttgctaacttttgtcttttctatacagattagtaactggtttatcaatgctcggagacgacagcttcctgcgctgcggaaccagatgcgcagtggtgcggatacggagtctcaacggcagtcgccttttagtgatgtggatggatcggagcatatgccctctcctcgtcactagtggcgataaacctggacctcgaggttcgggtttgatcacggcacccttcttttcgtttctattcactcttcaacgttacacggcattcgaaacgtcagcgttttattcactttacgactgggacgcttttatcttgtttctctctaccatttacgattcacggggttgaggacggcgggcttgatagactggcatctttcttcctttttcctatgtgtttaatgttttttttctccccctttctcaccttccatgtccctggagttcactctacatgtcacattgccgtccggtacgaagactctggccggacattatattttgataccctttctctatggtcgcgtttaccaagcgggaactcatttcgtgggaaatcgacaggcaaaaggggtacacgacaaattatggcattgggaatcccattgaatcctttgtatgatctactctactttgtggttttcttttctctccatgttgcgccgcatttccattgcattgtgtgtccctggacaagacccgcgaaaattgcattactaggtgttctttcaaatctgcctgacactatttttctacgcagcggtataacggccagggttcaaaactcgctttttgggggtgttgatgcctgaatgcctcactttgaaacggcagaaaaattaagatacctgaattactattacatatgccttaataagcaaagtacgctgtttctgctgacgttatagggttattataaaatgaagccttttgctcccatacaaatccatacatctccatttttggggaggtttaccctctccagcatgaaaatgaagcctttttctcccatacaaatccatacatctccatttttgggatggtttaccctctccatatatgaaaatgaagccttttgctcccatacaaatccatgcatctcccatttttgggatggtttactctctccatatatgaaaatgaagcctttttctcccatacaaatgcatatatctcccacttttggagaggtttaccctctccagcatgaaaatgaagcttttttttttaattcctacttacaaatccatatatctatctaaccctccgtctccgatggctccgccgaggtgttgtaaccggagatctagcccgcttccgcctcaccggctctgctctcactggctctgctctcactggctctgctctcactggctctgcgtccactagctctgcgtccactggtgctggacttggtgtagttacatagaaaggggccttatcctcctatggatcagcctcgaatgaatacgtatctttataccgcttcacaaccacatggagcttcgccttccgacctggaagcctatcaacaagctccttcacagtaccgtcaaaggaatcatccactcccgatatctatcgaggactatatttccccttcgcgtactatatctccttagcaaagtagcatttgtccgtccaccctagactgaaatcaacgatactcggtagcgctataataaagtaatccctcgcaaagctgtcgatatttaagaccgtttgtttaggacgaaggttaacggaaactgaagctataaaagtaataattagcttttgcttctagattatataggaaatatatactatccggaattggatttgtctctcttggtttctcctagagatagaaaatcactattatagtgatttgtttactcgcctctttagcggctttccgagcttcctctgcctccttaaacttcttagtataagcaaggcggtttccgctgactgtattgctccggaggttagcgaaccgagtgcttgtgtactaggctcgtgtaggtgaaggccccgctaacgaaggccccgctaacgaaggtattgctaacgaaggtattgccggcgttataggtgctactaaggaagtaggtgtaggagttgtagagtcgaactcctataagagggtcctaaaagcctcttgtgctatatctgacaaatatatattggtagagagtatattaaatgtgtagatgaataaaaatgtggaagaacttgatagataaaagaacctggatagagaatgctttaatttagatagtattttaatttgaacgatgtttttaaccgagatatctatagatagatttatatactaggctaatttgtaatattaaatacattttctacccttccgagatatactcctaatactcctctttattaaatatctccgagacattctctcctaatttatccactatatgctccttattgggatcccacttagctacacctattggctttatataaacgtcgagtatcggatcttggcccgaggcctaatgcctatatactcgctcccgtagctttatatacaccgctttaaatggagacttagagtcactagtaaaccgaagatccggatttatagggttaaacggtatccctataagctcttctccaattttaactagctgctagtaacactatacaaatgtgggcggtggaaggtatttattaggatcccattcctatatattatcttgaagcctttttaagagctatgcttggtctgatactagatcttagtcaatctcacacttgaagtccttcgtatcccctttcggtaagtgaaagtttattgctagctttcctaggactagatgttcttggcgagtatagagctggatagggtgggtattctaattctcggtgtatgatttaactcgcttccgtatagtttctatatagactgtaagaagagatacttgatcaggaatactatcttttgtaaagcagttttcgtgtgctaggcggcgaaaaaagcgcttcttttaaattagtatagaatcaaattaaatattaagttatagtgcacttatatagaagagcctagtggttgcccttgataatatcccctactatacctcaatacgctagttattaacacttcttccatatatctagcagtctttaggtttaatagagggattagcttagcgacgaagcttatagtggctattagctaaaagaacagtctctacacctcgattagatcggaatttccttggttaaaaccctctttcttagaaagcattagtggcttagcgtaaaacgctaaccgtagtgcgagcggttatactaacgtatatctagataatataacgagagtatccgtcaattgtggcatagatcttaataccgaaaggttcgagctttatatatccgtcaatataccatatatcgtttggtcctagggacatatagtttatccgttcgcgccgtgaacctagaagccggctttgtacatcttaaggccgaaggagacgctacgcaagctcaatttaggccctaaagtaggttagtataggatagagaattagagtatagagaattggagtatagagaattagagtagagcacttactctatataaaatagccctatagaacgaatatggcgatatagagtacggtagccaaagtcctcaaccttaccaataatattctcatagataagaatggcttagagatcgtcaaattgttgctatcgctaattaggggagagacgaagcttaatattaaggtccgctcgaatccttctgatagtcctctccgataaaggtctgccgtctacggcgagaattcgaagaatttcgcttatattaaaccgagatataagtgctttaacacgatcttaaatctctaccctaggggtaagagtaagattatagcgtataggcggtttctagtaaccaagagatctctatagggtactgcgactaattacgatattgtatcgttcttcgaggatagcgcggatgtctatatatatggtgttctggctgataagatcgagtatctcttctttgtagggctctagatcaatacgcgggcgcggcatagtttatatatagagtagtgtatagggaataaacatttgtgggatgacagcttgcaaaatgggaagttttaatatagactagtaatcgatcgggactagttattccgcgccggagagagagagtcggtaaaccatcccaaaaatgggagatgcatggatttgtatgggggaaaaaagtttcattttcatgctggagagagagagagagagagtaaaccatcccaaaaatgggagatgcatgcatttgtatgggagaaaaaggcttcattttcatgctggagagggtaaacctccctaaaaatggagatgcatggatttgtatgggagcaaaaggcttcatgtttatatgaatgtttacaatatattgtatagagcggtgtaaaaggcggtactcattaaggcatccaggcatcaagatcccctagtaaaaagagttttgaaccctggccgttataccgctgcgtactgacactatttttctttcttttccaaatctcattttccgattctgataattgtcatttctccatccctacaagcgccaacgcggatccgagatgtgaagcaataccgagatatggagtactaagcagatctcagctgcccaccgcgcaacccgtctccactttgtccccatcgcgactagcctatccatgttcttgctcgcatcccgaaacgtggatcttaccttacccaggctcttagcaaacaccctttcgatccccatggtcttgcgagcttggggactggcctggatataatttaccgcatgtcgatacaatatacgtgaccaaagctatctgaacacataattttcttgagccattttcaaggttccagggaaatgccattgaaagagtggcttgcgggccgggggcaaagggccagaaccatggtttggactgtcactaaaccactaaattccaaattgatagacccgtaaactagtggatattcgactccaccagggcatgtgtcaagatcgaccccatttttgactttttattttgttcatgacgtcgacctcgggagttaccaaaatatcaacctcatccctaccacggtctatgttccttttaactttcagataccgcttaaagtttggttcgcgagggacctcagtatgatctgattctgttatacgccttgaattgcattcaacattaggcttataataaagttatcgaaagtattaactttcaagattccgaatggattccaggcgtgaactgacagctgcatggaacccaacttaaacttcagcttttcggtccctccgtcggtccacaaatctacaaatctacaaacttagacatccacaaatccacagaggaaccactccagaccatggaacttattttgactttgtgtcagccacgtgagcccggattcgatccagatctccttctacacggggtatattcggggcttttttacctttgacagccccaaagcgaggtatatcgacgtgttcgaccagacttaattttgatgtggaattgaacatgctaattaaacatttacaataacggatggttcgctcaaccatacatggcttattctggaatattaactaagcttgctcggatgctattccgattccgaaacatacctgaattgagcgcgcttgggagctgagacaggtgaaattctcttcggtcgcaccacattactaacggattgtacctggccgtttctattttttgtgttctttctagtttttccgagctgaccccggaagacacaattatggggtcctgacagaccccgaaaaacttacttgactgccgatcttgggcttcggccaccctaccgagtagaattgaatcatttggaggggcggatacaataatacggattatacgatgtaggatctaccaccgctcaggtatgtacagatctccaaatttgagactccagtgaggggactgcaacccacttggttgaactcatattttgaaaggaaaaaaaaaaaagtgatatcaaattcgcatcccatgaaccgaaaggaaaaaaaaaaaaaaaaaaaaaaagaacaaacagggaaaggaaaggaaaggggcaaaaccaggattagggttgcagttacacatatctgccccgtgctgcaaagatgtaaatagcatctacggagtaatgtacctcgacatcataaaaagcaaaataaaaaaagcaagcatcccatgtatacggagtacaaagtacatatgttgtaccctcgggatacaacataaagatataaacgactaggggttgaaccccgtaacttagtcccagataggagggcagcggatatgcaagccactcaagccccggtatgcactatctctggcgtccacgactggccgatctcaaaagtaaaaaacgcacccaacgaaagtcgtgcagcgtgcagcgtgcagcgtgcatacaacttccagttttcgtcgagctcggccgaatcacagtctatgggaacatttatccaccccccttaccgttgtacccttacaaccttgcctctgtcacttgtcaaccaacccaagacaaaatgcccaaccaaatcccggttctgcgggttctgcgggttctgcgccttacactttccgaatctgtttccgcccttagatttctcgccactacggtggaaccccgatcggtgtcttagccacccccacttcagccattcggtatccagatacttgcatccgacccgtcacatagcggtgaaattggcgtctgacacttcgttgtgcacatgcgcacgtatacacatttggagctgtattaggcaactatcgcgcatatgctccgtacgtcgcacatatatgttgggtgctatgtatgtgtacgtcttcccctctgcgctgtcacgggcgcttaggcctcgattatggacgtgcgtgtcgatcacaacgacgtttctgctaggtgaggtaggaggcgtgcgctttcttcttccatcggaggtgtcaactgcgggatttgtgagctgtctcatgtcaggatttgggttgtgagatcgcgtgtagatcgatagattggttcgtgcgatcgtgactctcaccgtatactccagagaactacatagtactactaggacgatatccgagcacacctgtacctgtacggagggggtacagcgtatgtaggtgttctccatacattcatatttgaataattggatcggagtacggagtacgcggggcagtataatgtaagtcatataattcaatccgatcacagattggatttcaatcctcactttgaagggggaattgaaaattgaaacccttgacctacctgcttgaatgtaacgtcatataatttattgacaatttatttttagatgttcctcgctgcaagccgactgccatgatcgggatttgatcccatccaagcttcacacgaactattgaatcttgtcatttaatttcagacgatcgacagacccaccgttcgacgtctattatgcactaggttcaatagcgtcgtttagcctggccgcagtggcttttttgacatttgctttctcacttttgggggtctttgctcgggggtttgtattattgtggattagcgttatcctccgtagacgagatagccgcttgttccccatactcttctgtactccgtactatccgccacgatataatagcccgtgtttccaataatgtacgtaagtatgggtttgcgagccacgggtgtgattgtgggttcatggagagtcatgttcaggtaggatattgtgtgcctactccgtaccggaaacaggttcgatgctgtttattcgtttgtggtatgatgacatggctgcccacgttctaaaatgggattttattaattaacatgcctaggtacatacgtagatcagcttcacgatcatgttctatggcgcataccactatattgtaccagcaaagtatcaaccaggcgcttatcttttgatcgaccaatcccaactaccagcggcatgcagttatgtaaattatgtgctcttcgaaatgatatatgttgtgtatctataataccaagtcataactgtccatctgtgtgccacactcctcactctcccatcacagttctgtaaggggagaagcaagcagcacataaatgcaccagctgtcatgtgcacgaaatatgtatgaccgacacaaccaagttatacatgctgcacatgtaatgccacgaagaaaacaaaggagaatatatgagatatcgggcatgctactagatagatttgtcaatgcatatcacttctcgggtatctagaagctcgggcatctcatttaggacgctaatgcacactcgatgtacttgatgtcatactaccgtcgtatgtaagcatggtatttgaactaccttctagtacagcatagatgaatttactctagtgggttgcatatctaggtaactcggtccgtgggcattaatcgaaattatgtcctacggctggaatatctgcttgtaaacggtcgtaagtatatattatcttgacatagatatgagttgtacttctctttgcgcttcgtgcgtggtatcttctatgtttcgacttgggactgagactcgaattggggagataacgaagatagatacgccaattagatgactgtagagcttttaatggttttcgatattggatattgaattgtattagtaaaggcaatcccaaaaagagaccctggtcatgaggagattatatggtctggaggaaacggattatacctacagactcaacttattgatttttattttttactacggtgttccaaagaggattcctccagctgtatgatttctactcggcgtatggctcagcatgccttgctgtcgttctgctgtcactcccagtttatacagttatgtcggggagtaatcatactgctttctacagcgagatgtcttcttctacaatgcatattggacagaactacgtcgcatagccgctgtgtaccatgaggaaagaaatttatatgcgcttcaatacatctcgcgtaatgtctaataaattttcagttgcgttttctagacaagtttatgtctcgctggacacaggtatgactatttcaaacttcgctttttcgttgccacgcttgtttaggtctgcgccaggacaagaagattgcaactttggctagttgtgccaacgttctactatagcattgatttccaactgttgaaacacgcaatacatgtcttttatatatagctcttatatagccttatatagttcatattaacaacaacactctctaccctgtacataatcatatccatgcctcatccgagtcaagattaaaatcctacaaaaccagcagcatttcaattttgtgcagtcactaactttgtttctattttatcatctctagatcactggcaatacataactaggtcatgaaccagccaatctaattcctcacaaaaaaacgaaaagaaaaagcccccgaaataggaagtaaaatctggcttctggtagaattacgcagccaaacgcaaaatatcgactctacaagcctctggccgctgatacccacagtcacgtgcataataagcggtcataagcgactacaagcgggtctaagcgggtccgacgtgattttcacttatcacgcacatttgggccaaaaaatacatatccagcaggccggctggcccaatggcaaggcgcttgactacgaatcaagagattgcaggttcgatccctgcgtcggtcaattttttttgcaattgtttctttagctcagaaacatgctgctggaagatgcggaattgtgcgaagcgattggggggaagagatatctcacaatcttctctttttcttgattctgtcgtccataccagagaagaaaaccaagtaccaccaggcgaacgagagtatgaaaagagagacgaaatgcccgtagtcccacggagactggagtcatgggcagcaggttacttgaatgatggaaagcctcacatataaggtgaattgtaggggacacaatgcggatgttgtagaagcacggatcctaggttagtattgggagacgttggctcgctgtaacttttcccgtctgaggatttggctgctggatatcaccttcggtagagacaagagcccgcaagtccccatcgaatgatcatcatttataagttaccaagaaatactcccgcaagatcttgttatatagtgtggcaaatttcctagagaacgacttttagaaattgctcgccgattggcgacctgccaactataaggttcgtcgcccaaaggttctacacgttgactggggggcatgagctcgcgtttgcattctcatgtaacaatgctgattctcctagtcctttattaatttctttcggaaatcgacagaccatgtatgaatgcgagtgccctgggtcagttctgtaacctaacttatactcgcatatccccttcatacacaccaccattgtcaccccgtcctataaaatgaaactgcaactcggcgtcagtgtattcgtacggaataatattgggacgttcattcttggcaaacgaagaggaagcattggagcaggttcgtccatcaggcgtcaatagggaattgccacaaagactgccaatcttttatttccagatccaagatttttctagcgtctttacaattaaagaaacctggggcctaccgggcggacattttgaatttggcgaggctttcgaggcctgtgcagcgcgagaagtggtcgaagagactgggcttgtggtccatcacctgcggttcctggccgtcgcgaacagcggcatgcacaaagaaggcaaacactatgccgttgtttttgtcaaagggtatgtcaataagacccgagaggggggtctgccgcaaccgtaggttagtactgtacttgaagcagttgattggtgtgttttaccatgaatggcattagctccccgagcccgaaagctgcacgtcacgggagtgggtttagtggggtgagctgcattgttttagcaaggggcctgacaaaccaggatttgagggacggagactgtcttcgcctcttttagaattatttcagcagtagccagactttcacctgtagccgtgctgtgttaggccatgtgatattttatatagtgatgccaataaggagacggctttattccatattttaaaggttcttccagtgatctccaactgtgccatccgtgctgaatgttaaaataccgcagtaatcggaatcatgagttattttttcttgatcattaggagacactaggactacaggagatcccatatgcaaagtatgaacaaggtttgcactaccaaaggaaccaattgacatggtttgttaagccatctaagaactatttaagaaggtaacatgttgagtagttgactgcctaattaggaaggtctgaatttcagaggcggggtatagttagcacttccccatatataaggctggtgcagatcaggaaccaagccgcataatcggaaataattcctccacatatgggcacaatccactttgcaccttttgctatttcccgaatccacctttaatcccaagtatcgacttacgtcctacatgagggccttatatataaccaacagtctttcgcaggtgtagaatagtggtgaggagcttgacatccaacttcactagttacaggtggaaaggcggccgtttctagccccagaagcggtcattttcgtcaatttcacatgttatcgggttctggtagtaaaccaactaaagacgctataatgcatgttggtctagacacgggtcgagagatttacatcactaaacatgtgttcacacccatcgaccaaacaagatagggatatctaactgtcaaaacggcccttatctctgagacatgcatgtacatcttccctgcaagtacttcgtacggagtaacctatatcgggaagcatgccggtcgcgttgacggacatcaagtcgcaaatcaccatgcgagccgctcggatgtagacttgggcgtttgagtttagattcacgtcttgtggcttcatggcatgtgttcattggaggatccatggtcagtcggccctgcagggaagatgcagagaagcaataaagaaaagggggaggggaaaccctcagctagccaatcagacatagtttagacgtgctgcttgatctgactgcattgggttgttgacccctcgttgatgcatcacgcccatcgtgagagggggtatggctgtctggcgacacttgcgtgctgtgactgaaggtttgccaatgcattactgcgcctctgaaaaccgggcaatatgctctctcagtatcattatccgagacatgttgatgtgatcggcgtgctctagaaagatcttcctctatactctacaggattgcttctcccgaacctggaaagataacaatgatttgcatgaaaatagtgtctattcaacagtgggtccagcacttccctgatcatggtagtaacttataaccacgcccggaccggtgatcccaaccatgttcacatcccagccgttggggggcgcatcgccaaatctctgggcatagcttgcttgggctattccgccacgccgaaggtaaaaaaagttacgcaataataatctttagtgatacagctcgcatattgcagcttaatcaagggtcctgataacgagtcaggccgagggcatcggctagttcgttgccaaaggatgtgggccagggagctagccaacggtcgattaccccagagttcaacaagccaagcccaatccagtattcaggattatagtatgttatactccgtacgtatctttgtactccgtatattaagcgattcgaacagaccgcttctttatccgatgttcccgggttcagctaaaaagggcactaatacccggatgggtaggtgctaaaccctctctgcatgaaaattatattgcacgatagagtggacccttcagaggcagcgaaaagagatacctcggctgatttggggggatttccgcgggcgactgctgtatattcttccgcattgccccttagcgttgcgcgattagcgagtttaggataaattggaacaacttgctagggttgtatcccgggttaatattgtgattagtgaggccgaagctcaacactattagaatatattagacaacttgagggtgatgcttaatttccgtgcgatcggcgaataacatcaatgtgaatatcatatgaataattgtcactacccgctcccctttcgctttaaggataagacataattaatatggaggatgaggcgtaagcacctctgagatccaataaagaggaggcgaagactagaaaacaccatatctcgaagggccccctcaagtataagagcaaataaggctaaataagaacgactaactgatagaaggagggccactagggcattaaacggcatgatacccgttgttaagcgggcctagaaagttacaaggtcacattgctgccatctccaatcctgatagccatttctttcctttccctttgagacatttgcacatgttaaccaatgattgtccgagagactgctgtttgtctgttgtccctctccacttggatcctgatcctccccacttaagatcaatttaactaaggggattgccaaatcatactacagggtctgtggctcttgactctggacccttgcctagatcctttttaggtcggaattctccgagcatgtcgaagacgcaaaaaagtggttgtattagataggaaaaaagtgaaaggactccgcgatatcttcggaattcggtgaaataagacaaactagtcaagaatcaaacgaaaaaggatgtacctagtatagatcgcgccactcagccccctcaaaccccctctcctacggttttcgtcggggaaatcggctcaggggggtagttaatacgacattatcaacccctcttgaaagtatgcaccgacaatcgctacctttctagaagccaacgggaagttgtcggattggtggatgcatattcgattaccccaggtccgccatggtccgctataatccgccatgaacaggatatgtatgttgtacctgcgcggacgcttcgatatcgtcagtaatcggtttcttgtcgcaattggctcaatctcctcacccagcctagtggccctaatgacccgctattataaggcttggatctccctgatagacatgagatgatcttcaggttgtttgatttggtctttgcttaagggtctaattgttgatcagcctttccttcctattttccaacttctcaaccttcccggtcgatcaggcatagacgatcccctaaacagtacatacctccagtacacttacagtaaccattcaacctccgatacaatgacgagaactggccctccaattaatcctatctcgtgggacaccaagactattgttccagatgatggcagcagaatcgattcggtcgcttgccaggatgcgaggccaaaagggcgcatccgacgatcaatgactgcttgtcatacctgtcgcaagctcaagactcgctgtgatgttgatccccgtggtcattcttgccgtcgctgtttgtcacttaggttggtttcgcctttttattcatgtgtttgacatatccccgatttttactctttttgaagtctcccgtttctctatatgctgactattgtcataaaaggcttgactgcgagctccccgagacaacagagcggttccaggacaatgcatcaacctggtctgacgccaccgctgtaccctcgattgaggaacggctcgtctctctcgaacgaggaatgggggagatgatacatctgatgcggcagatagtgaaaagctcccccagcatgccctgcagcccaaccttccaaactagaaaccacagcatagatggaacatcttcaagtgatagcatgtcctcatctttctatccgctcaagccagcgcagctcattcgggacctgcaagccgaatgcttcggcgagagagctcacttctccgatgctgacatcctcggggatatcgtcacccagggcatcgtagattccaagctttccgtgaagctgattgaactgtgtgtctgattgtgtgtctgtcactggatcgccctgctaatgatctcgccagttttgtcgaacatttcggccactgggtctcaataaatcactcgtccagccttcaacggtcgaatacactccttttcaatactgcatgtctcctggcttcgcgctatatgcctggcctaccacaacacactgtccgcgatatctcactctatgtacaacatgccgtcgcgaaggtgttgtggaagcccccgcccatgacaagcgatatgctgcaggccttgaccttgctttgtctctattccacttctattcacaaagaaggcctgatggacgactggttgctgagcgggatctcgatcaaccatgccctcatctcttttaactttctcaatactttgccaggagacaatttaagtccagacgaactccttgctcagttgcgtttgtggaatacactctgtgcaacccaactacagtatgtcctgcccaacaattcgtcaggtatacaatctaacaccaatccaacagctccgccctcgcaaacggccgcactgtcaacatccaacaacaatacatcaaccaatgtccccgcatcctagagcatgcaggtgccacaccagaagacggaagaatcgtcgcagagattcaactataccgcatcgccctccgactccaacacagccagagccgcctccaatttgcagaatctgaatacgaagaactggagcgctggagaatggagtgggcacatctcctaagtacatcaaccctcccctatatgcccagccactgcaatcccaatccaaatctaacagcgacacccacagccaccaacggagactcaactctcaacctaaacctctggttctgccaactcctcctacaccgaaccgccgcgcgcctccaaccagacagcgagcgcctcctcccagaaatatgcggcaccgcccgcctaataataacccaattccttcaaacgcgcttcacgtccgcacccgctctaatcgaccacgtctacttcatcgtcggctacgccgcgctcacactctgcgactacacgctcaccgacccattaatcaaccaagtgcgcggcttcctactgcacctcgcgccaggcggcgacaacctctcctaccggatcgcgtgtattgtcggcgaagtgcagcggcgctactcagaggcgactgctgttgtggcggcggggtcgcattcgtcgtcgccggttgccgaggtcaagggcgcgcagatgttcggttcatcgcaccatcatcgtaccggtatggagctctcgcagctgatgtctagccccgagggcttggattcccttgttgagggatataattgtcttgagcagatgatgcctgggtatgcggcttcgcagcctgcatttgaggcgccggatttgtttcatcattctcctacgactggtgttactggtggggctatgcctattggtctcgtgcccagggctttgcatgattggtgatgaggttatgggttggtcttttggttctagattattggagttggtgcatgttgaactaataccgaggttggatttgggatttgggtgttgtgttatgtttctttttacttgaggatcgtaataacaaaagtacaaatggaaatttgtcctgacttcttcaactggcttctctgtttcgtgttgctattcatcaaagtaatatatattacctatagctggattcaaattgtattaccttggtagttatctggcttccaatatgcattgtcgtctcacatggcttagatactccaatacttcctcaattcagcatccagcatggtctctcatctcctagacaccaggccaacaaaatatgatagtattatgtataaagctgataaaccattcgaaaggaggtgtccacgggtatggataaaaacaccaactcagatgtaataatatatacactttctccttcccaataaagcaattggaaggaatatctatctatcaggagccctcgaaagagggtacaggcagttcggcctcgatcagccaaattaccaatatctcgaacacgaagtctatgatgagcacagagccgagccctcgagcaaagacgtggggagcaagatcctcggcgctccactcgccataggaacagacacctccccactatcaccaacagtaacactagtgcaggacacaacctcagtcaacttcgcaccagccttgaatccagtatcaggaattgaaactgaatactctttaccccctgcaccgagattcgtcaggacagtgattgtctgtccaccgacgaagcccttccgcatggcgatggcgctctcgtctttgtagattgggtggttctgtgcagaccgagttagtctcttttccttcttctccttcttattttgagacacagagagagatgagcacatacctggtaaatagtataattggtactcttagcaatggcctggtttctagcaccattggccttggcaatgagcttgtacagctcgctgtcggtgttgtatccggataaccacagagcctcgcgattagccgggtcctcgccaccactgtagtgctgctcctgtcctgcatagacaataggaatgccatctgccataatggtaaatgtggctgcgttcttggcgagggcaatgtcatcggtggcactggattcccgaggtcagcttctagacatacagaacggaatcatactctgtttctttgcatggaatttccacgtactgggcaaaacgtgggttatcgtggttctccaagaaatttccaagaagggttgagtccttgcaggtcgatttcaccgtgttgatcatgttgtacagatcggtcatgcttcccgagctcgactggaaggccttgaggagtgggtagtaactatttgcacgagttaggtttggtttctctagtagattccatgacaagggtctcacatcgggtagttgagcactccgtccattacctcctggtatggacaggtgtaatctgggtcaccatcaaggatttcgcctacgcagtagacgcccgcggctttgttgtagccgggccagaaatctttctggacatgtttgactgtgtcgacgcgaagtccatcgactatatattggtgagtttctagatacggcgatatctgctgaagcaggggagttcttttttttttagaaaaagaagaaagaaagaagcttactggagtagttggagaccaatgatccaacccagtcataccatagatcctgcacctccttgctctgtgtattcagatccggtagcgagaccttgttatcgccaagccagcagttttgcgacatggtgtcgtcgttgtaatcggtgattgggcagtaggagtggaaatactttgcatcgttgaaggggttgaatttggtgtagtccacgtcagcacctgcgccattgtagccctttttatccaatatatgtcagtctcagtccaggtgattggtggcgtgggtgatttgactcaccatgtggtttgctacgacatcgaccatgagatacatgtcgcgtttgtgcaaagccgcagcgagggccttgagatcgtctgcggttccatagttggaatcgagagagtagcttagaatttgtcagtaaggatgcaggttttgacgaatttcttttctgctttgcgatactcacatatcctgctgccagtatccgtgatagggatctccgtacgcggtttccccgctcaattgaccggtcaccggagtgatccaaatggccgtaaagcccattccttggatatagtccagctaagatattggttagttgggtgatgtaggaaggatcagactgttactgaccttgtcaatgataccctgccaggttccgccacagtatttctatccactatagttagctctatctcaatgacatagagcctacgaatagataaaagcttactctgtcagcggtatcacaggcagcagtagttgaaccatcggtccgggcaaaacgatccgtgagcatgaagtagatggactgcgagcgccattccgctggggtcgcagcaatggcagtgctaaccaggccggcaagccaggcaagccgagctagaaccatcttgtagatgtttcaccaccgatagctcagtaacagaggagaggaaagtcgctcaacagaacattccaacaaaaagcgctgcggggccttggtatatataccctgcgaaaaaccatacatacaacggcatatgaaaaaaatattggagacggatagccgttgaaatcggactcggtgcaggattatggcttaagctaatagacgccaaaagcccatatgaagatcgtcacagacgatcgtaaatggacagtaatccctctaaatccccgaccccggtcacagcaacatatacaaaagtggaaaacagagagaggtctctgtatggccaagaagtccataattaattcacagataatctcccgaaaggaaaaccccactatcatccttcacacctgatccgtcacatcttgatttcccccagcccggtaaaatacagagtcacaagggtatagatgcatgcataacctggaaattcccaggtgattagcccagatcacaaggctacggcatgtgcaatattaaccctgtcgcagcccctgacatgggctttggtcgaatcagcgtgtgcggggcctacctcaaattaattacaaagttgcaatggctattagctcgtttgagacgatgtggatcttttggatattccgggttctagtcggggatcagtcgatgctaacggtcttggtcttggtagatgcgactagatgatttagggtatatactccgatgttagggggactctagggctactagtaggggtcttatgacggacgaaacgcaaagacaatttatatttgggcttcataactcgggccgacataggagattaaaattcgtggatctttgaatagccgatttgggaatacgaccgaggatccatggacaagaggtagtcgtatgattcctttcttactcggctgaggtgaggttatacggagtcgtcactttagcagtgggtggtctttagagagtaacctgaaataagacaattgggagatattacgaaggaaatatgtatataccaataagaaatccagcgtgacgctatgaatatagatgaatctgactgctattgggataaattatagagaaaacagcagatttgcattccgaaagactcattttccaactatccctcaatgcatttcacaatttaccacttcaaagcccagtcagcactaaaagcaccctttctggtcaacttctgcaaaccgccgacggacaacacacgcgacgtagcattatactgcaccccagaagccggcacaggtataccattaagcttaacagcatcaggccgcgtagacacaccaagaacagtaacagtagcgagaggattcaactcttcccagctaccctttgccctagcactcaagctggactccttgacactgaaagtaacatcaagcgtatcatccggggcattactctctccatcatcgagatacaactgtccagtggcagttccgctgccaccgagcgcgacaagcaaagaccaaggcgtaccacgcgcctccttcgtagtcagagccggctcctgcatcggtacgacgctgcctccacgcacgaaaacggggatatggcccagcggggcaggaatggtagtgttgacaccaggcttcgcgtccacggctgtctgggtgtaccagtcataccatacctcgccgtgcttaaggcccgggaagacacccctgacagaggtggcatggggagcaagcaccgggacgaccataattgaggggccgaggaggaactgcgtgtcgactgcggccagggaggggtctgtagggaattcccaggccaaggcgcgcatgacggtggagccggttgtgtgggcttcgtggaagagggtgtagaagtaggggaggattgcgtaacggatcttcatagcggatttggtggcagctgtaacggattcccagatgtagggctcttgggaaatcgcggagagggtgttgtggttacgatagaaggggaagaaggccgataattgcatccagcggttgcagagttcttcgtcggtgttgccgttaaagccgcaggcatcgacgccgaacatagggatcccgaagagggagaatgagagggcttgggggatggagaagaacatatatgcccacctagaggcattatcaccaccccagtggccagcccatttaccggagcctgcgaatgttgagcgaccgatgacgaagggacgcttcttttcatcgaccttaagcagggcatggtaggtggcgttaaggatttggtgtccgaagaggttgtgcacatcgtactcttggacgccatcggagtgagtggcattaggggacacggcgtgtgagctgaggtcgtggccgtcctgatcatggttgatcacatatggcgggtagttgatgttgcgtactcccggagtgggtgtagtccgcaggtaagaggtggacgaagaggtagaaccgccagttgtggcggtagcagcttggctgaacgacgccgcagatgcagacgcagcctcagtcttgttgctgagctcaaacccttcgggataatcataaataacgttaccaggctctccaggcagggcaaacgcaggatgggtcgggttcattctaaggtttccagatccgcagctgccagtgcagaaggaagaaacctcgttcatatcaatccagatgccatcaatggcgactttcttgtgccagatcacgatttcgttcgcccagaaatcacctgtcttagggttgtgccagtcggggaagacagtgtagccgggccagacggcgccaatgtattcgcttccgtccggattcttcaggaagacgtcctcttggtgtccgcgggtgtaggtatcatagctggatatgaatcagcaaggttttctgcggggcaggcccaggggaacttacgtatcagaggcattcttggggttgggaatgtagatggccgcgtctataattggaatataatgacggccactgctgtgcagcttatctaggaatttttcaccatcactgtagggataacggtgttgatcattatcgaagtcacggtagccatgcatgtaatcaatgtcactcctagtcaggttagattgatttcaaccatcgcggcgagccaattttaccagatagtctcgagtgggatctcaaacttctcaaagttggatacaacttcttcaagttcagtccagttattgtaaccccagcggcactggtggaagccgaaagtaaaatactgctgcaatgccggtaagccaatggtgctcagctggtagttcttggttacacccgcttgactaggacccgagtagaaagtgagatcaatgctacctcccagggagcgccacttcaggccctcaggattcatgacgacctcctgaccgtgcgcgtttctagagaagacaccatgagagaaggaaacatagtctttagactgagcggccttgtcacttgcaacgagggtgtgatgacccttgtcgttgacctcatagtagcgggtgtccagatagaaaggatgggagccgtaaacattgctggtgaaagtagtcaggatcgaacaagcaatacaatgcaggggggacgcttttgggaatgaaacttactcatcgataggatcactaatatcggaggcataaagagtcaaagtgagattgttcaaaaggcgcagctgctggatgtgctctccgatgccatacaagttgtaatccttgggcagagaggtaacaaactcaacaaactggttttcaaacaccaagacggaatcagtcgtatcgaaaatggcatcaccggtagccttgcgggtcaccttgaaatagaaagagggctcgttcgaccaggcgatctcaagatcactatcttgctttgaagcctgacgatcggaaatggatcgaggaacgacatgctcatccaacatgaaccaagaatagttcgaagaatccagatatgtggggacgatttgaacgctgaggcggtcattggcgaggtactcaatggaaaagtccaaggagtctacgtcagttccatagacattgcacggctttccggccagcgtcaaggtagcagtcaccccacgagcagactccttgacgttggatgccttgtacccgggacaaaccgactgcgcatcgacagcttcagggtcatctatattggcgatcagctgtgcgccagcctcagcgctagcgggaatggtaaattgagtgtattttcccgaagaagtcggagaagcggcagaatgggagcccgaggctgtagaggcggatctggagaaagcaccataggccaagagccaagcaccactaagaaggttcttcacaccaaccatagtgaccacttccctactcacagattagcttggcgaccaggggagattttgtctcagatagttctggctcgttcttatacggttgctgggcgtaaccggtccgttctagggacttgcggacagggaccaggaacctgatggtatgccgtacccgggacagtttctggtgattctctgcacatactctgcttcgtggctgtctttgcgaggttcgtcagcctcaacctgacgagagctggactgtgtagaatgcggagagaagagaggtcccttacgtcgacccgacgtccactaataggactgtataacctacatgtacgacgtacaccaaagaggggtataggttcgttttagactacgttctttaagatccagatataataaaagaggtcccggagctattagaagaggcaagttccactccagaatcctatacaacaatatacataccgaagaacaagtgttagagtatgaaatcgagactgtgatgagaacaggaacaagtagagtacaatgcggataataattactccggtctgttctataatgccgatcacaatagatcatgccattgctgatgattggccagttgtccgataaatgcccgtctacaataatagtaggctacagggtacctgatcctggaatcaatatggatgcatagtctgcttacatagaaattgtagtggcggatgatattgtaatcctctatatgctatatggcaagctgcagtgagccctttctctccggtggagaaccttataactacgagatgcccggacgttcaaaggattttggagtaatttgaggacctcgggactctcgcaggaatagtattcaactggttgaagaagtttattcgaattgggcattcaactgctcaacagccccacctcgactaaactgtacaaaccatcaaactatagtgggaaaacgttgtatgcgcttcaacctcacgatatacaacacaggagcccccatttcgcactttcgggaagccgagaaggatacgagaatagaaccatgtcggcactggtaggatgcactaccctgtcgatccaaatctatactcgtatggctatatgtagaccaagcttgaagaaatcgattggatcggaaatcaacttgcgaaatgcgaagcggagatgaatgctcagggtagcctagcagtgcccactaaatactaaaatggttgaccggcaggaaaatcccgcatattcgattctagtgtccctgtcaatcaatatggagatgccaagcatagccgacttggtgccgtaatggccccgtgggtacggagtactccgtacttggccaagagggtactttgcttccggcccgagattgagatccatgcaatatcagcagaagatcataaggatatttgggggatacggagtagtgactcaatgagtcaactttcatggtgatcttggtgatcttggtgatggcttgtatcctttatagtccgaaggctgaggggtacgtagacagccagagaagtcggcccgagagaaatggccctaacccagaagcgtcgttagaatagcaatatccataaggaagccaatgcgaattaagatcaaaatatgaagcacacctgggcaattctaacgcaggggctctggcggggtttttttccttttcatcccccgcttccccaggtttgtgttttttcttttattaaaatgggccatgccaaactccccggatgaaaccatcgcacttttttttttatacctttcgaccttaacatgaactcaactctgctgagtctagtaaagacctagcaataatccaacaatgtccaccaaacagtccaagccaaaacaagcatgcgacaactgtcgccgtcgcaaaataaaatgttcccgtgaactaccatgcgacaaatgtcaacggctacttctctcctgctcgtacagcgacgtcctccgtcgcaagggccccaaatttcgcactctgtatcccctggccccgatccacccgctctcatcccgacaagaccctcccgagactaagtatcccgaggacgccggtaccggcgagattccggactaccaattcaactcgcccatttcgccaggctttataatcgcagactcgcaattcgcaggccaggacttctcggatactttttcccacctgccgcccccggacctcgtctcctctcccggctccacggactcgaccgtcgaatccgccattggttatggttatggtcatggctatgcgaggccggtcgcccgccgtctctcgccccagatactgctcgtccatgtcaatatctacctcaagtacttgttcccgattatgccggtggtccgcgcggaccagctccggttggattgccatcagcccgggcagctatctgcgcagcggtatgctcttttggcggcgctgtgtgctgctacgcatatccagttgaagctggatggggcgacgcctgtgccggatcctgcgcgtttgcagagtttcggggatgagcactcgttaatgtctggggaagagctcctttcggaggccgtgcgggcacggcgggattgcgatgttttggaagaccttaacacggaatcgcttttgacttcgttctttttgtttgcctcgtatggaaatcttgatcgccaggatcaagcttggttcttcttgtgccaggcgacctcgtttgcattcacacttgggttgcatcgcgagtcgacgtatgcagagtatgaggctgaagaggcggaggaaagacggcgtgtgttctggcttttgtttatcacggagaggtaagtggaccgatttatgaaggaccatggtttggactggagctgattagtaaattggcagaggttacgctctccagcaagcgaagccggttatgttgcgcagctctattcacaagccccaggtcctttgctcggaagatcctattttggcttatggattcatcaacctgatcaacattttcgagaatctcacaccgaacctatatgattggatgtccgccggcggtggagatgggatcttggagagaccgccaacctccgccatccaatccagcctatgcaaggctatttccctagagggagtccttgagatccagcaggttgatatcttgatcacgcaacaatggctgcagacgatgatgtggaaactatctatgagccatgccacgcaacctggttcgtgcgatgacgcagttttgccatttcacctcccagtgatggtgggtaaatccgtgatgagcgtgattggtgctgcatcacagggggctgttgatgcgcatgggattggaatggtaggtcccccagagatgaagttgcttgtttgtatactgatttggatgttataggaacaaaagctcttcgacctaggctcctctgttgctgatgtgacgagatctcttggaccaaaagccgtccatagattggctgagtcgattattgatccgaacgagttgctgtggggtatacttcacactctgtctcagattcgtggctcgccctcatacctcttccctacattactggatcgttgcagaaacgtgcttggactcgactgcaacatcacaacgggaaatttccttcctatactcggcgctgctgtgccggatcagttggcttcatggtctggccagcatgactgggattacgctgccagtgcggaggatattgatatccatgacgttgatggacaagccgagtcagctcctcatccgcatgtgccgcaggaactaggcttcgaaaattgtctcttgtgatgatgggcacgactgtattgaatttgtgatgcggtttttcttcttgtttttgtgataccaaatggagatttatagatggttgtttatgatatggaggaacaacagaattgtagaacacgatcaatgactcaatgcatcaaatccatggctattgtagttgatgtacctcgtaggtcgagaaggaagctcatactcgtgaatggcagtcaaattgtcttggcatgtttgtctcacatggaatctccaattcggtgatcagcttcatgcgacttccaaggtttctcttctcaattgctcaggctattcttcactggtatgctctctattgctttctacatccctcgtatgtctccaattaacgcttcctcgcagataattctcgggtctccgcatcgaccaaagctcattagagcaccaaaccccggagccaattctccattggacctcaaatctcacctataaccaacaccattacctacacaatggcctccctccggccccgtgccctccctctctcagtccgaaccctccgctcagccctcagctcaacaagaccctcaccaaaccacttcctctccgcacccgcatcaacccaaacccgcgcgcactcaacatcctccgtctccgccgatgaactctcccacttctccgctctcgccagctcctggtgggacccaatgggccattcccgaatcctgcacctaatgaaccccctccgtcacgaattcatcgcctcctgcctagcagaaggaacctcctcaccaagccaaaacccaagctcaacctcaaccccctccaccgcaaccctcaactacctcgacgtaggctgcgggggcggcatcttcgccgagtccctcgcacgcacaatcccactcgacccaaccggcccagccccaaccccaaccctcgccgcctcaatgaccgcaatcgacccctcaacggacctaatccaaatggcgcgcgagcacgcgcgcatggatccaaccgtccacgaacacttgcgcaccggtcgcttcaagtaccttaacacaacgctggaggatgtacttgccggcaacgctgtcactctaacgcccgcttcaagttcgactgcggcttcgaccccaaacccaagctctccctcaacccaacccgccccacaatacgacgtcgtaaccctcttcgaagtccttgagcacatcgacccgaagacctcaacacctctaagcttcctgacgaactgtctgcgcgcgctcaagcccggcgggtggctaattggatctactatttcgcggacgctgccgtcgttcatcctgaaccaggttattgccgaagcgccgtggccgattggtgttgtgccccgtgggacgcatgagtggagcaagtttgtcaaccctggtgaggttaaagggtggttgcaggaggggttgatgagggcagctgatacgggtgtttcgaggggtgggagtgcgattgcggaggggatgaggtggaagtgtgtgggtgctatttatattcctgggattgggtggaagatggtgcctgggagtgaggattgggggaattacttctgggctgttaggaaggagatttagatgattttggggatctgtatgtatctatacttgcattgctttgagctatttgtatattattcgacttattgtactccattgcatatcaatatttcataacttcatattcattaactcgtttctagtgtacgcagtacacctcgctaaatgcacataaccacccaacctattaggcacgcagtagaagaataccggcggataaccctagaccattcactccaatccaagcaaaagtaaacacaagatttccctaaccccaagctacttcttccccttccccttcctcttcttcttcggagcagacgacggctcaggcacagaaacagttccttgctcaacatcctcaccctgcccctgcaacctctgcgtgccactgataaagaacgtcaaatcgcgattctgctccgcaagatccgcattcgcagccttaagcccgtcaacctctttagcaagaccttccagccttaacatcatattccgattcatagccttctcttcctggaaccccttctcaaacgagcgcgccagggcctcgaatttctctgcttttttctccgcgcgagcgcggtcatgttcaagtgacggcagcgtctcaatcgtcataacatcatacttgtcttgtaattcctcgaggcgtgatgtggcgctggaagcgttgacttccgccacggcggcggcggcactagcctgcgatgctttgtcgacggcgcgctcgacgacctcttcaaagtatgcacgctggctttcaagctggctggttaggagatgtgtgtattcgatgctcatgttttctagtttctcgcgggggacggcgtcgccccagtctggtggatcgagggcgctgtagtctgctgcgggtagctcgagaagcttgccatctgttttgttttggatgatgcggtggacataggcgtcgcctacatagtcccatacgcgctgggaggtgaggtccatagagaaggcgtgggctgtttctttccagtgggcgaaggcgtgggcattgtcatagcggccgcagccgatcgtgccgcagattagacaggcccagaggttttcttctgagtggcagacgctgcattctagaggttcttcgtctggtttgagcgaggcgttgcttttgcggtagtcgtctggtgtgtatcggcatacggggcagccggtgcctttccacttttggagacaggtgcagtggaagacatgttggcagtttatcgtcaggagccctgtggtttcgtccatccgctctaggcagacgggacaagttggtagttcgattagagcaggtgtaggtggtgcaagaggtttcccggtgagagttgcttgtccagtagaggataccgggggccgagagggggttgagaggttagagacagcgccattctcagcggatggtgttccggcatccacaacttggatttcgaccgtcttcacaaaaacaacatggcaggtctcgggctcgatgctattaaaaacacgcccattccattccttctgccattccttcgccttccgcccattccggaacttcatcagaaccatataccgattcgcacgcgccgtcctgatcatccgaaagtgactaacatcgtccatagtcttctgtccaataaaccccaaaaagtccggcggcgacagataagacggcacagcgagaatacatagtgtcgtacaatcctcatcagggctgtgtgcagtggaagaacttgtctcaggaaacggatattccgcaagacccttcgtcccggattgtttaatatccgccgcaccggtcagaccctgcctcaacgtagcttgctgctcaccgggctggcgggcggcagctgaggagcccttcagataggcggggtactcatcgtcatttccgaggtaggacgtctcttgagagtcgcggtacaggtgtacaattccccagacgctgtcggcaagctcgtaatcgagtgggatatactggccttttgtatggagaccccctagaatgtcagtgccgatgcctgcagcgacgaggttctctggttccgtggtgggtgcggagccgcgcttcgaggtgcgtttgggcggattctttggggtgaccatgtcaatgcactcgatgcagatggcgccaaagcgcttgtcgtcttcaagttgggtggtgctagttgagaagccagtggaggggccgttagagtcgtgagaagtgctggcggaggaaatggttcgcggtggggtgcttgcggtgttggtggggaaggtggatatgggtttatttcgatgcgccaaagtatggcctgggttttgtggggtttgattatcccctgcgggtgatgggcggttggagggtgaaggccggctccgttgttggaatggttggagagcttcccatgcggattgtagcgccagagaggatccctgcgagctcggcgcgtcagattggctgtgggagaggagttgcaagctaaagtggtagaagtaagcgggcattccgggtgatggctcgcatcctctggagcttgcgactggtggttggaactatcaaaagaggaagtcgtgttatcacgataaggatgcatgattacttaatattttattgtcgcccgcttcgacgccttccgccacaattggttcctggcacgcgagagtggcaaagaggcaaaaacattgagattctgaggcgcgttctggttgggaaggtgaggtggcgagaaccggtgtggttgaacgaaattgcccagatgagccacttacacgccccggggggcttgcatgtgtccagtgcccgggtgtgatgccggaggcttaaagatgtttgtgttgataacctttatcatactatgtcaatttctgtcaattaacactatccacctacaactacattataatgaaatgatatgctaggtaaagactagcaaatattgctagagtgaattgtagagaactatctatcacatagccgtgatgataatgtgggcaagtaaaagagagaagccgtcctcgggaaacattgcaagaaaagaagcctcagcctcgaaaaccgaccaaacgccatgcaggtcatgtagaacctatcgaagttgagaaaacagaatcgtaaatcaattactggccgccacgcagacgcaacaccaggtgcagggtgctctccttctggatgttgtagtccgaaagagtacgtccgtcctccagctgcttaccagcgaagataagacgctgctggtcagggggaataccctccttgtcctggatcttgctcttaacgttgtcgatagtgtctgagctctcgacctctagcgtgatagtctttccggtcagagtcttgacaaagatctgcataccaccacgaagacggaggacaaggtggagggtggattccttctggatgttgtagtcggagagtgtacggccatcttcaagctgcttgcctgcgaagatgagacgctgttgatcgggaggaatgccctccttatcttggatcttggacttcacattatcgatagtgtcggatgactcgacctcaagtgtaatagttttgccagtgagcgtcttgacgaaaatctgcataccaccacgtagacggagaaccaagtgtagagtggactctttctggatgttgtagtcggacagagtacgaccgtcctccaactgcttgccggcgaaaataagacgctgctggtcggggggaatgccctccttgtcctgaatcttggacttaacgttgtcgatggtgtcagatgactcaacctcgagagtgatagtctttccggtcagggtcttgacgactgtggcaaatgttagtaaaaagaaaatggggccgtgagagaaggaaacacgtacaaatctgcatgccgccacggaggcgaagaaccaagtggagagtagactccttctggatgttgtagtcggacagagtacgaccgtcctccagctgcttgccggcgaagatcaaacgctgttggtcaggagggataccctccttgtcctggatcttcgacttgacgttgtcgatggtatcgctggactcaacctcaagggtgatggtcttgccagtgactagagagaggaatgttagcaaggatgtccatgggctaagtggcgagaggaggtcgtctctcggcgtcggagccaggtaaggggataaacgtacgagtcttgacaaagatctgcatgatgggctttattatttgagattgatttgaaaggaaggatgctcaagtgtgaagcgagctgtggagaatggtggattgaaagaagggagaaagtggaagaggggaaacagcgtccttatgtaggaaaccttggaaggatgagggggcgaggtgtcttagtcaggcccaggtgacgccgtgaaaatgccagaagatgccggatgagtcaaatgggggggtgcctgggaacagcccatcacttcacttgacgccacctggaaaactccgaaacttatatatcattggatatggcctacaaatagactattattaacattattaagattccatgatcttccactgttctatatgttttcctatattttcctacattttcctacatcttcctatatccatcaagtcccctttgtccaagtgatgacgttatgttgcttatcgccaaaagagggggtgggaccttaaaatggagacgctagtgactagaaagtacagggtacggggctgtacgcggcaactgctgcggtctcccgggtacccagtacccgcttccaaacttagtatcaaagtcggatccgggttcaccgctgtcttttctttctttttaatagttcaatagttaatcaataatgagatatgaaaaaataaaaattcaagttttagagttaaaaactatcgagatatagagcataaagcccggtatgaacaaaacgctttcgcaaatatccctcccgacgcttttccccggcaagaagatatgcgtcaaccaccacaaagaatgtgagggttcagggataagacagcctgcacaccctttctcagggccctgttctaacttgaattgttggcctgtttcgtggcgggtgccaggtgccaacaaaatgaaaacaaaacaatagaaacaccttcggccgtacacggtcatgacattcgtgatcctcgttcatcgctggagacaaagctatgcgaagaaaggtatacaccaaagacaagagcaaaaaaataccaaaaaataccaataataaagggtaaaaaaatgaaaaggtaaatatgacaaaagacaagaccaaaaagaaaaaaaaaaaaaaagcaacacggctcataaaaggctagatcaaaagaaagtcggttcgctcggaacaacaatacaaaaaaagggtagaacctcgctgggagggggacccgtcggattcttcgtcaaaagagcggaaatagatgcgctcgcacatcgtcacgacaatgattcgcatattctcgttatcatttagcattcaaaacgaaatcgcggaactgtactcgctggaaacgatagtcgtggtaatatcatcatcataatgcgtttgcgcatcggggttgttgtctagttggcgcgaatgaccagtcgcgacacaaacttatttgaaaggcaatcgaagtcgccacgattgaatttcgtgcaactgcggctgcggaggtaggtttctgaagggtggagttagtttcggatatcaaactggaacattgggaagagcttgtctcttttgtctcttaccatgttgctcgacatgttggcggacttcagtcatggtgttgcagacatcctggttggagtacaacagctggtggtgcttttgcgagtcccactcggtgaacgggggcagcttctgtgagatggcctggaacagtccgacgatgacgcccaccggggtggtttccatgtccgtgcagaacttgtcgacggcagccgcgtctggtgtccggtagtggctgtcgaactgcatctcctcccacacggccagcagaatggaggccaggatgaagatggtcggccagttcttcagcttgtcgccgctgtatacactcgagtaaagtgacgacagctcctccagcacatccttctgcagctcacgccacatgctagccatggcacacttaatctggaagttgatcatgacaggggccatggtcttgccggagaacttggagcccatgttctcgatcttgccgaggaagccttcctcctcgccaataccttcgaccatggtgacatgcatggtgaggttgtaagcaaccaccagcttgagtgccttccggataacgggcagcttcgtgcggaagtaaaagcggaaggcggtcttcagcatttgcgtcaggaaaggagtgccctcgaagtaatcgtcgacgaacttctcaaaggtgccattgccgtcgatgtggcggtcaaggtaatccgacagcatcgcgtgcgagattccctccataccagcggagagtttggcagtctcgacctcgtactgtgtcggatcacgctgcattgtctcgatccagtcaacggtgaagcactgctcgtcacggacatagacctcgcgggcgttgatgggcaggatttgtccatatccgtgggtgatgaacaaagtgcgttcctggtccgagaatccggtaatgttgccgacagagaagcccatggtaatgtggcgctcataatccgccttccagtccttcatgaaatagccaatctccttgatatcaatgcgagtacatggcacctgccataaccgtgcatgcgacggttggcatcctgcacaaggctcgcccttgtcacacgtcttcttgaggaacttgcagcgcaggcaagcgcgcaacttccggatctcactggcctgttttcgctggtcgggcttcaggggaccctttctcttgccaacacgcttctcggtctcgggcttgccggtctgggactgcttgcgaaccttggtctcggcggtcttggcggcaatggggctcttgcgggacggtttccggctcggcggtgaggcagatgcttgagaagacccagccgatcgagcaggggatgttgacttcttgatcggaaccgggatcggccgtaccattccgacggggctgacggcggaaggcgaacaagaccctggcgaagactggtcacgaaggacaactgcgctgcttgtcggggaggtaccgtggattccaatggagctactgtggctgtaactatggctgtggttgtggctgtgagtatggctatgactatgactgtgtccgtggccatggtgactatagcaaggcaaatccatattgttctcggaaccgggagatccgatcggattcgtgatgtccacaaagctgccgtatgaggtggaatatgaagactcggaaaggctgcggtcgtgcagtgtctgggtggggttgacgaaaacaccttgttcaggataaccaaagtcgagagagcggcgatggtcgatagtactccagccgttgtcgctgctggacagggaacggacctccagataagtgtcggtgggcgaactgctttcaaggacggggtgcggggcataagaaacatccggaagtccgttggggaacgccatcagatccgcttggaagtcctgatacgtgaatggcaccatatcgaccggagccgacatcggcagatagggaccatcgagcaagccggcgctcatctggccctggccgggcatgagatcgacgggggatgactgcatgggcatgccataactggtggtaaactggggcgctgaggacgggtcttcggaggaatatgagaggtggtggtggtggtgaggggtgtgtagtggttgaaagtgccagtcgaccatgagatttggatcctgggtcaccgactgttccagagggtgaccgccagtttgcaacggggagagaccatggccctcttctgaccgtgggggcgcctgatctaccgcgacaggccatgattgatgctgaagatagcctctggagtcgtaatcgacgccaataaggccatcatttgatatatcgacattggacatgacttttttggagtcaaaaacgaccacggggaagtaaaagagaaggggaagaaaggaccagcctggatgagaggaccttcttcagaagggtgacacaaccatgaagaagagggaaagtgaggcggtgggggggacaaagcagcggtgagcgaagaaatgcgctaggggagttgattgtggagagtggagaggctggctgatggcgtggagggaacgttgatccagtgttgagcgatgaattaatgccacgggtattagcgtgcagtagcgttgattccgctaggatttgggagggggggggggggagtaggagggattcggagaggggagagaggagatagagtcaaccctggaggtcctcttagccgggaagtcccatgatctccctatttattgaattctttcctaaatgggaaaggttgcctttttttttttttttttctcttcttttctcttaattcatatactatttcatatactatttcatataatatttcatataatatttcatataatatttcatatatctattctactattttctacctaggttctgactgagatccttactattagcaaatcacccgtgagcccgaacccggaagatcagtgggtatcactgcgtggcaataagaattggcgagatctgacatcctgttatgttcccgtatactaaatctcccaaaatatcccaaatatcccaagtatcccaaataccaaaattagttgagtccttcctaatcagatccaatcagctccccgtccaccacccgtgattcgtatctcattgaatgcgccatacctcaaaggtatttagcgggccagttcaggatgctgatgcagttgggagttccccgttggaaaataagtagctactaaataataaataataaactaagcactagtaagataactagttagggaaatagtaaaatagtaaattagtgctcggctatattgcacggactctggaaatcttgttgagccttagtatggcaaaacaaggaatcggacaggtcgacgtttttcttaaaaaaaaaaatatttcgaatacctgggcacatgcagcaagggtgtcatgtaagccaatatactgcgtgcatggcgtgagatccatcacatatatatatatgttgggtccttgtgacatgcaggagctcttcagtgagcacggagtaatactcgagatatgcatttcccacgagaaagtctgtttctaactgaatcaggatactccaggactcgaaaaggttgaaaagggaaatacagtgaaggacatgtggtgatgtcgtcaaagatggtcaaagatgcccgagagtggggaaaacaaagacttctattttacattcacattcatatctacagaacaatagtaagaacgttcaatttacctttctttgagcttcaaaatctacaaaatctacaaaatctacaaattcctcaaatccccgatgccgctcgggaaacgaaaagttcgatttccgcacgcacaaaaacccaaccgtccaacctcatcaattccaatgacttcagccatgaacccgtctgactccaaagcgcgcccggggatcccggccttgttcacgcagccgccgcccattcgcgacccgctcatcacagagaccatcgatctgcagaatgcgaccctggaaaaatgcctaccattcctgaaaggcatccacagcacccagaaggatttcaacgaccatggcgtacccgccctgcaacgtgatctccacatcagctacctttacgatgccctcgaggattatcccgaggggttcgtcgccatggacgccagccgcccgtggattgtgtactgggcgctggcgggactggccatgatgggagaagagacgactcgatttcgcgaacggtgcgtgcatgcttcaagtgtttacatccttgctttttattttcatttttattttttgaagttatttcatttccccgcctcgttcttcccccaaattgttttttactatctgtcatatatccacaggatggagacagagcctcccgaagtctggaggagatgtaccttgattggaaaggatcatctcttctgtacaacgtgaaacatggaaaaaagaaagaataccattctgaacattcctcttcttctctagtgtgatcactacgcttcggcccatgcagaaccccaccggtggctttggcggcggccatggccagacatcccacctggcgggcagttatgcagccgttctgtcgctagctatggttgggggcgaggaagcctttggattggtggaccgacacgcgatgtgagttgtcaccggcagctttctgctgcatgtgcgtcttgtgtgatcctgtgcgtctgacccagtttctggctttcccaggtggcaatggattggccggttgaagcagccagacgggggattccgtgtttgcgagggcggggaggaagatgtgcggtaagtgaaaccccaggactggagcaggcgcttgctcgtaatcccgttccccttccccaacgcaagatctgacatgtcattaatacagtggcgcatactgcgctatgactcttatctcgctacttgacctgccgctgacgcttgctccgggctctcaagcgcgggaggctggattggagagtctgacgagtggtcttcctgaatatctctcacgatgtatgagttactggtggcttggcttatagtagccttgagatgtgctgacactcgccttcaggccaaacattcgaaggaggtatctccggtagccctgggtcggaggcccatggcgcatacgccttttgtgctctggcatgtctgtctatcttgggaccccccgaggagatcttcaacaggtgcgaggcttatctagcccggaatgctctctctgattctcgtatgctaatagttcctgacagacacatggacattccgatgttagtgtcgtggttgtctgcacgccagtccgccccagaaggtggtctttccggacgaacaaataaactcgtggatggatgttatagccattgggttggtgggtgttggccattgcttgaatcttccctagagggaaagccggatagcaccgagccaccagccaacagtcttttcagccgcgaaggtttaacccgatacatccttggatgttgtcaagggaacgacggtggtctccgtgacaaaccgggcaagtatgttaactcctatccgtgacgattcttttttacacgtgcagctgaccatgacccaaggcatgtcgattcatatcacacctgctacgttatggcgggtttgagtgcggctcaaaaccatcattaccggacagactcgagtatcgcaagtaacaacttttcgtcctcattttcctggaagtcttcaccaagccgcgatccggccaatgtgttttcaaggggtgatcggctagagccaatgcaccctttgtatgtgatcccgcacagagccgcggagcaaatgcggctctggtccgaggcccagcctctctttgtctagtctggaggggcgcgacccaacaccatatcagaaaggagacacggataatgcgccacgacggatgaggtttccttcggaaagtctcgcgacaatgtagtagattgaagcagggtgtcattggtaaccagggactccgagcaagtgcattatgcatgattagtcttggatgcttgagactgcaagccccgcggtcatatcggcggtcatggcatgggagccacgaggatgatcttttcgaccgagccaaggaggatgctgtgaacgagaccgagacgcaaggggttggattcggggcccgagtatgactctacagcataggtcatagcacatggcaccaattccttagtttttgtgctggcagtttcaccgattttccgaagttcacagaaagttctttagcgcgaaggttttacttgtcccgccattctcgacgatccatatgaaatttgttcctacgatgtacatcataatgtgtttgccaccaaaatgaacaagctgcacgaggcccaagagggcaaaagtaatcgtcaataccagaatatgcggataaatccaacgcctttctccactgcaatgccagctcatcactgcgtccgatgcctgtcgagtaactcaagttcctcggcgcctgcattttcccattctccgatattggattccaattgccccctctctactttgcttacctactaggtagtttattgactatttcattgactcatagccctttcacaagcaattggcccctcttcagacgcgttctgcacaacatgaacggcccctccttggctccaatcaccatttgcagacctgcgcgtctcgatatccataagggcggcagatttaattgcgctttctctaatgcgtctgcggggtcaaaaatgaaagagatcattctgagcaaccaatgccagcgaaaaaaagtaaaaaacaacccgtgtacacagtatagtatagtatagcaccactatagcgctatttcattccaatcactccggaatactgggatccataatcttcaggtattaccttctgcaagcaggttacaaggtctcccttagtctccgagaatgtttatgtttcgatcggcgaattgcaggggtacaagcagacagctcacggtgactcccggtgcctcagactcggttcaattctactggcaaagagacatgccaacgcatcagtaaacccgccgagaaaacggcacacgaaatacatcgaacatccgtttgagttactgttacctttggttttttggggcctttctgaggtccaatgcgcttgcgtgcatctatcgtcttctgttctcttcttgtactctgtttacctggtggaagtagtctatacccggattccagatccatgccctagggtctcttttgagtttgattgtttactatactctgattatttgtttactagtactgcttattattgtttattgtatacttgactttgctttttttaaccttccatctttcaacggtgggtattagaatcttagtagtttgactttttttgtttaatagctttttcttcttcaggtcatctgcattgacaccaaatgtcttctttttcctagatctttatgcgctgtcgcaattgcaaccgtttcccttctctgttggtactgtgtacaccggccagctcacagtatgacttgggaaaggtatcaatgcaaaagccccacctgttttttagaagtaatcaagtatatggcaagcagcagctctgttcccctcattaatttgttttctttttctttttctttttcttttttttcctgttgtacggaggaggggagagtcggttctagaaaattgtatatctgtatatgggtgtggcatctttccaatattcccttcgcaatcttgatttagttctcaatttctctctactgtttttcaccctcgcgcttttcattcactcttctttgaattagacactcttgaacttcactagtattataatcgtgcttttgtttggaacgccagcacaccctccccgctactagcaaagcaaacgccattgggcatcacgatccgcatatttcctgactgcacaccagctagcagctcagcctcagccctaaacccgtctccctgcaagccagacctatccaatgtgttccaagtaattgtcgcaattcgttgcagttggacaagtggcaacgccgtcgtccgtcgcctgtctctagttttcccgtctttctcgcttccagcttgcgtctagtccaaatcccaagatgtactatatcctatacctgaccagtatgtcatccttgtcatcattctccccaccatccatcactacctcctccccaaaccatgcatgtcatataacgcgaaccaatgcccccaaacccgttcccttgccaccgtatcccaaacacccaatgcagaaaaacaaacacccaagaccttaccttacccctccatccccactccactccaaccaatcccaccactcagaacccaaaactaaccaagtccaaacccaggcctctgccgccgccgcaactggcccgaaccaatctacaacgcctacacaagcaacagcggatacacatgtaccgtgcgcgtcaacaaccgcgagtaccgaacagacggtatctgcagcaatgagacgctggcacgcgagagcgccgccatgcgcgcctacctcatctgccgcaatttctccgtcaacgacggcatgtaccccgtgggacatgagcacggcggcgctgtgcaggggatgcgcgttgccattggcgtgggacggaaacctgctcgtgaggacgatgtgctttctttggggtctgcgagtgggagtgggagtgggagtgatcggtcgcggggtgggagttggagtggaggggagtaggcctgttagggttgggactggggttgggggggtcggggggcggtggtttcgcggagggtttaattaggtcttgggggaggagggttacgatttcatgacatgacgcttacgactacgcctttttggtatgattgtgggttcttttagagggaaaatctgtgggattttgaatgtcccctgtgttttcgttgattatggtatggtgggactaatgatgattttgcatgtatctagatggtggatttatttgtcgtttgcgagtggtggttagcgatgaattctgctatgaggttgtttgattttaatagctgttgaattcagtctatgggacttgccaactagtggacaactggcgtacactactccccttcaaggtgtcggaaacaatgaccgcaacttagagcactcagtgttctagtgttactcttcctattgaatttacactattgtctgtctctaactgtacttctgttagcttacattctggactacttcaaaaatagacagcttaggaaagcgcctggcagagaaagtctgatatctaaggttatatttttagatttgagacactacaggagaagggaagtgaatagtttgggtctttctagaaaacaaacaaaatcaatacatctaggaaaccatacctatagctcaagccgaaataatcaaccctacaccacttgtatcatgttctatgtccgacttggttccaaactcaaactgagtattgcaatgcccttgcctatcccacatcaccttgaagtctctctctccctgtctggccctgttgatagtaaactttctatctaaagatattcatcaatgagctgtatccattagaagtttgtatgtcagccaggctgatgcctgcccaggtggtttgtcaggccagacctcactgtttgctaactagctatattagctagcctgagtctgtcagagaatcaatctcttccttctttctgtctctcccctctctggctattccagctcaaagtcccattccggcaagatatgcatccacgcaggatcatcggctcgcttaaatcggataaaatcgtacagacgtaagcaaagctcatcatcatctggtacatggtcccttacagtctctgggacgttagaaagatagcagcggagcgctattagaatttcgtcctcggcagattcaaagaatccgtcagggaggtatccatcaaaaacatacttgttgtggataggagcgtagattgcctcgagaatatctagaatggaagcttggtggccaattaggtcgacgataccaagtgcttcccatgcctctgtctcattctcgaaagctttccgcccagctgaggccatattggaaggtggtaagatcgaagaaggtaaatggatatggtatgctgaagtattgaattgtcagatggttagtcggaacgctgcttgattctgaatatcggaaattgacgtggaacttgacgactatttaaccgattggtacttagttagctctttgaactcgaatagaataatacaagggctttcaaccctgaatcttttgttgcattgtttgcgtctcctgtcaattctccaaagaggatatcccagaggaacaaagggaactgaagactcaaggagattcgagaaagtaaaaagccattgtttagaacaaagtaatgcttcaaagaccaaagcccgggaagctctttgttattgatacaagcacggctaataggacgggacctggaagaaataacaaaagcctgctctagtctaacatgaagagatgatccattaatgacaactacccaggattacccagtatagaaatagaattatgtcagtcatgtgtatggtacaaacccattgttagcttgcaagtcaaaaatatttgaattgtgatgataggttgttgtctgaagaatattgctgatatgggacaagaaagattgaggagccacaggcctaaagaatattgattgactaggtgggcggaagggggtttttatagatgacccctgacctcctcctggatccatcacgttgcccaagtgccttctctccgtataaacaaccccccgaccttctagatagtggacatggggttcttacataatatgtaccctaggtacctacctaggtaggtaggtagtgaaggctacagctcacagatcgatcgacatacacactactcacacccagaatggaaaatactatttccatgccggttgaataacatattgcaacacgccaaaagcggggtttcctccacttccaatcaccctaccaaaaatgaagccactagaaccacaggaacaacagttctacggtctcgcatgggagggagactttatttgttctaaccctaaatggaccgttgaacctgacattggggctataaagcagacagtacagtcgctccggccatcaagcacggttgaagtgactttcctcgttcagggtggattcaacaagatctacaacgtcagcatagatgatgaaccatttatcatgcgagtctcattgcccgtcgatccgcgttacaaagtcatgagtgaagtggtaacaatggattgggtgcgccgtatcgcaagcctcccaattcctagagttatcgctcaccaaccgtctcgagacaatctgattggatttgaatggatgctaatgaccaaaatgcccggaaagccctttggtgaaatttaccagtctctttctttcgatgcgaaggcacgcctagttaggaagcttgccgcaggctcagcttgcctttttcgaaatcaattgtgtggaattggaaacatctatggcgaatcgtctgttgttgaaaattcaacatcgagtgaagaaacatcatctactagacagctgattgataccagaatatcagatccggcaaaggaacccgccttagatagtgatagcgcacccacgagcgcgaactcgggagttggcttactgagtatccccgacaaagattcttcagaatgggctttacctcatgtgggccgcattgtttctatgcaatttttatgggattcacatatccaccaagatgtccatcgaggcccatttcgctcaagtgaggactggatcacgtctcgcctcttattcaacgaaaatgactgtcattcggctctcaataaacattcagctggagatcttgatagggacggtgaagccgaagtggaagacgctacaagaacgctgcaaatcatcgacaacctcaaatcccttcttcctctggtctttccaatgcacaaccatgacccagagccgtcaatgatattccatcatgacgtctcaaaacacaatatcctcgttgatgacaatggagaactgactggcctcctagactgggagtgtgtttcagcggtgcctttatggaaggcctgctcctatcctttgtttttggacgagaaaccacgacgctcagagcctatccctccatcccaagatgatggaggttccaatgaactgtaccttgaacagctatggctgtatgaagccactctcttacgcgatgtattcattgatgagatgcgaagactagacgcaggatgggtggaagtttttgataagagccaggtcaaaagagactttgactgtgccgtgaatgaatgtgactttgaattctctgccgcggatattaatgcatggatcaaagatatcaccgctggtataagcaatccacccaccctgctggacaggatgtattcattacctggtctccagactgaaccagtgcaacaatgattgcgttttgaattgtgatggaaggaaggccacaaacctatgagccagctcaatatccatgaccatctacaatacagagactgactaattacaatatagtgaggtcgatatctgccctgaccacaccgttgaagacctgactttgtggctgttgctccacaatttcaaggaaacgcgtacaatgtacggagtactccgtaccccgacctaaattatgttgtaattgtacaatgtaggtcaaaccaataagtgggctcttccatcatcgtacatgcaagaacaagtaatcctccctttcgttacatcaccgacctgggaagttggtcgactcttccatggaaagttgtttgtttgatgacgtcagagcttaaaccctggtaccagacactgtgccatttagtataagtagcccccttctgcttctgccattgacttcatctttcatacaatctacaaaccttcaaatcaacaaacatctgagactttcaagctcatttcaacaacctctttaacaacaacatcatggaaaccgccaaggttcgcatcatcatatatctgggtgaatgctgtcttctctgaagtactaacaccttaattttagaacgccgttaactacgtctcggagaccctccagggcggtggtgcccaggcatcaaaggaggccaacaagaatgtcgccaaggattctgatgctggcttgggcagccgagctgaagccgcaaaggatgctgttttcgacaagaaggacgaggcgtcccacaacaccaaggccgacgttaacaagggtaagatcgtcgaacccaaacaaggctgtggcatggaatcaatgctaatgatatgcagaggccgctaagcactaaacgggtgggtgctgatggaaattgaaccgctgtggaatatgagataccatttttgctagcacctaggtgctgggcagacacagctctttatgtgtataatatttgcgaatgactttatgccaatgaatgtaacttgatatgtcctgaaacttgcgcgcaatgtgcgtatgacctgctcttccctttgccttaaatcactattatatatctgtaatcgaacatttatgttgactgatatcgatcacacctaattctaatcaatatccccagaaactattagcagaaaggtgtacaactattgaacccagaaagcaacctttcaacctttttgaatcttggaaacctgggggttgactttatctgatcggatccatatgtgacgtcatatcattgtagaacaggatataattcggctgggtctcagataaacccacttgtcactttcaaacctggggtttaagttgttataattcacgtcatcggtgatcagtaactaaccaggtgacagacccgaaaataaggaggcgaaacaatttcgcccaatcctactgtgtaccgttatgctcactaaaaccctaattctacctaggtatacacacatttcgtcatcgggtggaaggaggcacttttgtacaaaaactggtcttaggctaaacttgccactctggattcgaaacgtgttcttttattttgaagtcacctgcaaaatactactgttaagaattcagaaactaaaacagaaacaatactacgctcgcgattgtcgcacaagacctcttagtgctagtctcagcaacaatgacatcgattattacttccatcaaggacctccttacctccatattcgaggtgatattctctgtggtgaagagtacgctggatacgggctatcagctactcctagcttttgccgacttcttcgccggtattcctaagatgctacagcatctgctaaagggaagcttggaagccacaggcggggtcggggcattcgtcgccagtaagtttcttatgtgtgatgattccgagaaaagtctcaagctaatgttcttgtaaaaggtaacatcgtcgttattgctcttatcgcccttggtagctatggctacctggtatatctacgccgtgagggtcgcccagtgcaggttacgaccaagaagtcgaattagggaagaatcgaattaaagatacactatgactttacgagtccccggcggaggaagatctatgcctattgtaatagttgttgagggctgcgatactgaaatactagatactactagcataggaaaatcaggaagaaactactcttgtcaagcaggccatccttatatgaagaagacgagatgacacgagtgacacagccaaagggaagagtgctacttggttatatggtgactacctctttgccctatctcgacattgaaagcggcgtcactcagattggggtctgctgtagtgggtgtcaaattgctttggaaaaggatctggggtcatctagggttcagtctaatgcttgtgttctacgggacaaagtgtactcctatgacgaattcatagaacatttacgggaatgtcgaggagctcgaaatctatggaagttggggagtcaaggggttgagttgacatcaccgatatctcggaattcgtcaagcgtggaggacacttcataagtcgagatgttatcatgtccttcaacagcgaatagcacgcggaatttctatttacgatctttctagtgagctagcgagtgatgcttagttttctgattgtaagcccggcccatggatatttacagcgcatacgggttgttaaagacagcttcgcgggacgcaaagtccagtttctacgaatgcagattcagaagaatacatcctagtcctacttttggacgcagagaatcggatctccgggtcctaaatatgatggacccttgaattgtctttgagcattagctggctatagatccaggtcatcttttggttacccactcggtttattcaagtttatgttgagctgcgggcagctaatctgtctaatcagctctcttcttgccgcgcatgatcttgcgtctttgggcaatcatgtgggtgtacaggatataagaacctagtaggtagtcagtaactgataatacaaacacctcataagaaagaacaacataccaggtacatagatcaccagaatcgcgatcaaaaggtaacggaaaagcggactcagctcgccagcaggaccaagggcctgaaagatgagtgcacactcgctagagataccaatggggtagaaaacgtagaaagtgttgtatctgttcaatgcgaaacccatcagcccgttgaacacggtagcctcgtcagaaagaaaaaaagaccaaaacttaccgcaaccaggtccaccagctaggaaccgagttcccagacaaggtaatagcaaagaatccataacggataacctccgtaattccccaagcaaaaacacaccccaggtacgcataatcacccagctgggtatcctgcccagcaccaacaatctccccaccaaactgcgccataatcccccacaccaacagcagccggctagaaacctgcatggcagtcgtcatgaagggcgcgcgcacgaggcccacaatactgtgcacaacttctaacagggcgagggtctgcgtggccagcagtagcggggagaaggtctggccgaagacctttgggagggtttggttcgatacattggctgggaggagagaggccgtgtagacgacacaggtgccccaggcgaggaggttgagggtgttgtaggtgaagaggtaggattttgttaggcctgaggagccggagcgcggggcgcttgatgttttggttgaggccatttttgaccggggtcgtttctcgtcggtctcgtgggagaattggtggtgatgttgccttggatggaggaactagaaatgttgatttggttgggaagctcgcgatcaacaaaaaaaaaagggaccgaggtcgcggttccttacgtaagcattctggaagagccctagagcccgcgaagaagctgtggagacaaagcgtgtttgggatctggggtatggcacatctttattttgttgttcattaggcttcttggtaatgcactatttattgagggtatatgagcatcgctatagattttatgttatcagtacggagtagtcgggcgctacatgctacttagccaatcacccttttaagaaagcacccatgcagtcgctttgttgttcactccgaatataatccgtagtcgaaatgtcgcatccggataaatgctctctgcaagcctggattatgcgaacaatttttagaagctctctgccgaggaacaggcttgatgtgattcgctccaggcaatcgagtacatgggccggcagcgaagcggatggcttcctatggaggagctcttggctgccagggatacaaagactagctgactccgcggtgtgaaactgcacgatctagtccagactactgcaagaggctggctgccatctcgtattgccggcagcacacatgcgtagtctggcctattctgggcttgactggtttgggtggtatgtccgaaaggctagatggacagacgggcagatatcggagggattgttgttggatgtgattgctcagattcgagatgacagcgcttaatttaaggagttactcggtgagcttagcgagggccccacgttcagcagaagtacttcaatttattgtccggttgattctccggtatgaatggaccgtgatgcatgttaattaccaaaggcgaggaactccatataatttgcatcatttgtatttggtgctacagcagccattctcatgttgtatggaaccgtgggttcacgtatgcgaactgacatcatgggctgggccactacaacatatgtcgccctgtgtatgccttaagccttttgaggagatggaaggatctgtcagcacttggggtgagaagtatacaatctgctaaataaaccttgtacagaattattagggtacaccaagtagaaacattgaagtaaacatcccggagtatgttattttgtaatttgctgtaattaacgtagccgtatattgctgtgacgctaaaatgacatcagcggctggtgtgggtggaactactaccccatcgcatgatgtcatggcaactatgccatcatctcattggtgggtaatgatagagaatgtgctagtgccaaccacttcgcgcaaaaaaataccaggggaaaggagatgcacgcccccatttctctatataaacaaagatggctgcggctcgcgatggacatattcgacctcaattgatatacggagtatatatctaacctatgttgtatacaccagtcctttcataggagaacccgaaccgtgaagctcgaccagaaaaaaagcaataaaaggaacaccaaaacacccaatcgtcaccggtgacagcatattccctcgtgtcttagcccaacaatattacccccctttcttcccctctcgagaaggggaaaaaaagagccgtggagccgtgagctcacacattggttcaactcactgttaccgactcagatggtggaatctatgcaacaagcagaacgaacaatttctgagttactggacacggtccttgagggcccagaccgactgaatcaagtcctatctgcgcacttggcccaagtcgatcgtgtttccctgctgtgagagccgggattattacgtcttaccttcttttcttgtctttttttccttttttttccctttgcggctaaaactttgctaggacagggtgttttttttttctgtttttttctgttttcaagcagtacagccatgaaaaaaaaaaggtgattctccaaagaatggccccagggacaaaaggaaaaaggccattgccatttcccccaaatgggttcccaaatgtttccacgtgtgaccgtccaaacttccaaatttcgcttgggagaagaccaaatgacgttccgtgctaggatcggcggtccgatgatgtcgtcctgctgggccctccttcccgctgccagatgggtataggagccctcttttttgcggtcagaaaacgtgtcgtttttatttatcattttgttttttttttataccctatcagtctccactaaacccgtactatccagtacacttacagcaggtcaccgagggattgtcccgttcattccgtgcattttcttcccggacccatcagttgaagaactgatgccacggtcgtactccactagactcatgaacggagcacggtggaatttgatccagagataacagtcgggactgtgtggctggaaatttaagatgataacgtacgatttaaccgagaaaaagcaagtcgaaaaagcaaagtgtactccgtacggagtacaagattgcactaatggtgtcggacgtctatagaattgctttttgagagaccttgacggaaaaagaagataatcgcgttttcaggaagaacgagtgcaattagaaaccatcgtatatactgtagctaataatataacatactatagttccagtgcaatgtttccgagttgttcaacgccaaatgagaggaacgtgggattaataccaaatattactgattttatatatccgacatacaatattcaagtgagtatgaaatgaacaaccgttgttttattttttggcaatttttcacaatttttcacaattttctctgatatcttttcccccaagacctccaattcccatctgttagtttggttcccttcggattggaattgacctacccaccttctcttcgctttctcggcccctccgatttcctctcttcccaccccccctcgtcttctttgacttcctctggtttcgtatctttttcttttttcaacgttttttttccttccttttccttttcctatttgggatctattgtctcctttttcggtacgtggtcatctccaaaactgagagggaaagaaaaatattataggtgggatggactttcctatctgcccctctctcttcgaatatcttcctattttcgctgtcttcaattccctgtcaagtggagaccctggcttttggggctgcagctcttgcgatgcgctagtccttgtttacaaggctgtgactggattaccgtccgagtatatgcgctgaatggccctgtttgttccctctagcccatataccacctccacatctggttcctctaattctttccccctccaagccctgctgtgtactacccctctattcccctcgaatcttttcttgactttccctttacccagccctggtcgctatcttgatcactcaatctggtggctgaatttcgcctcggttccagcctcttccccttggccatagacccggagccgctcatattgtcgttgacagctcccttgctaccttggttcctggatccgtaacacctgctggctttgtaagacgacatatgcgttgtgtgcagatcttgctattctgacgtccttgttgtatcatcgttgatctttacattcaagacctcacattcattgttttgccacactccatccgtccaagatctggatctgttgcatgaatctgagctgactgggatttgcaagcagatcccctcatattccatctggattggctgggcatcagaccggagaaatcgaacccatttccatcctacgattgtgacgatctgcgcattgcactaggttgctcccgcctactcctttaagcatctccttcacgcacacacacatacacatacacaaccatggcaccagccgatactaaaaaggccgagtcggtaagtactacttggcccgtgctcgaaggttcctcggcctgacatccgagtctagggcccgcccaagctctctgatcacaaggaaatcctcgacgagagcacattcgaacagatccttgagatggatgatgatgaggaggaccgcgacttcagcaagagcatcgtgtacggtttctttgaccaggccgagaacaccttcaagaagatacaaaaggaaatgtgagtgatgtcttacttgcaggaattcgcggtcattgtccttttactaatcattgcacaacagagatgacaagaaccttgctgaactctctgccctcggtcacttcctgaagggctcatcagccacactgggccttgtcaaggtcaaggagggctgcgagaagatccaaaacttcggcgcccacaaggatgagacaggtcttattgacgaaccggacacggagacctgcctcaaggccatcaaaaagactctggatgaagtcaaggtcgaatatcgcaaggtcgagaagctcctccgccgatactacggcgaggaggtgaaggacgaagaagagaagccagaagagaaggaagtcaaggaggaggagaagaaggaagaaaagcccaaggaagagcccaagaaggaggctaccgagtccaagaaggctaccgagtccaaggagactaaggagcccaaggaagcctcgaaataagcggtcatgcggactggttgatatccctccctcccctttttctttttagcgacggatggagcatggcaaatggctttttctttttcatttcccccctttgccctttttcactcactccctcttatcatcccttccgaccctggcttttctggctttcttgacacgtacataacaacctccaccatatctccccctcccgcccggacactggtgtggaaacggatattcctggtctgtcacgtaggtgcaggcgcgagaatcgtgacgattccgaggagtcttgaacaatagcgacatacggaaatccgagtgcctctgtcaggccctgttttctcttaacctacgccttttccaaggttgtttcgtgggtcgtatagtaagcattgcgtcagtcagtattgaagtacgtgtaacgcgagaagtaggcacagggacgtcagaagtaagaagtatacatatgtagccaaagtaatcagccaatgtgcctgaatagtttgagcaaggttaagtatttcctgagaatcagctaactccaaaccgagaagtggcgctctaaaaagctttttaccttcagccacttgcgtgggcctctggggtccccccggataaccttggaagcttgactcaaccttggaactttatactttgcccgatgcgggatagtcgacttagtctcggatatcttgtcttccatcgttcctcgataggttgtgttaatctgctagacctgccgtgacattcagcagagggtaagtctgttcactcttactctccttcccatgcccgattcactcggctgtctatctatcgtccaaagatcggacagcatcgctccaaataggtggaactcattaactggtgagatccgatctaatcgaaagttctggtgtgtgtgtgtgtgtgcgcgcgcttgatcaaggcaacatatccattcttccactattcaccccaactgacagcaaatcctgcacatttgcatctgcatccgcatccgctcttgcatggctaatggcgaatggtaaacgggcaccgggggcctgcagtatggagatggtgcgacgccggcgactttcaacggcgcgctcacatattgctgaagctgagattttgctggtttgactagcttgagttattgcacgctctgtaaatcctaagtcccacaaagtgccccagagagcgctattcttttccaagtcacggtttaatacggcagatgcagatactcctcatatctccttgatctggtcatcccagccaaagctcgatctctcaacagtccgtgccagtatgcaatgcggcgggattatgcagtgagattcaaatcgcgatggagagataatccgccttggttggccctcatcttgtgcacaatgtgacatccgttctttaatcggtgcgccaacgaggagaagctccgtggagccggatattgcacggcagggcctcctgtcagtatttacgcgtcgctttcctcctcatgatatatctagttgctctagtcgccacttgctagtcgccaaactagccttcggtacatataccagctgcaggtgtatcttcaaccatatcgagttacaaaggcactttgtcgctcggagtccgctcaaaatgatagatgccaatccaaacaatctgccgtactcgttgccacgttgctcgtcttcaaccatcctcccattgcatatgcacccatcgcaaacgagagattgaatcgagtcaggccatctgccaaccggaacccctttccccgcaacgggacgcaagtacgcgctcaactccaagagccgatacagatgcaagcaacagcaccgattcgggttcaggtctgtcgaaattgtgcttaattgcatcctggcccggactccggcctggcaggtcacacaagataaccaacgagcgttgcttttctgcaggatgcccgcaagccgacgggtaggcacatgtgccttatttggctttattcccggctagcaagggtggcttgaatatttcgcttgttattgggttgggtttcagtgggcctcgacggcgggttcgagatgcacggtctgattctcctggctcgctccacacagtggatgtcttcagtcgagaatgggtctttccggatctggttctgttgagctaaagctgtcgacttccttaacggcggatgcgtacaggtgagtggaaacgagattagcatccagagatactagctttctctgtggattacctgcctattactaggtcggatggggacctcgacgtggatccggtagtgtgtactccgggcagtgtacattatacaaattggcctagaaaacacacccctttctcatgcatgcaagcatacatatctctacccgtctgtctcggatagcgaacctgagctcagtaagtcgccctcgatataccaaaaccaaaccacttagcctgccatctttgcgctcagtcctcgatcccgagttctgggtccacgatgactctgtttgcgattgtctcggtttattcgacttgtcaccttggctcgcaatacgtttttcttttcttttcgaaagggtgagtgataggtagagggtaggaataggaggctctgtactacttccctctccttttcttctttcccctccctctcttctataatagtaaacgcgctctcgtttgccatatcgaagcttcatgcccccagcctacttcccacagagaaagaccgtagtacaacgccgtagccctattcgttagattccggcccccaacggtttactcaccctgcacacgccaatccactaaaaatgaagtactccagcccggaccgcatttgacgtagtccggggttgtatatcaacgggtgtgcagtgatcacccacacgcacattgtacatgtaccacccgactccacaaatcctgcaagaagtacagtagcgtctaatccaagcgagagaatcgtaagcgcggagagacaaaaaatcacggaataaccaaaaagaatacctcaactgcaacactggcctcgtgccctccctttttatcttctttgttggtcatgcatgcacaaaagaaacaataataatctttatttgcagatggggggttagaggtattgtcttagcctcgaagtacctcccttagatccctgctctgctccgggtccttgggcttgtgctatatcgatttgattgcaggttcgtcctttgccccatttccccaattccccgcttggtctgattgcgcctgtttctgtctcttgtcttgctgtccgttcgctctgcttcattccggcatagacgtctctgattgtatcggcaccgcggcttcggcgccatgcaattcgcagccaacgaccgttagatgggtttccgcgccattgagatctgtttgaatgggaggggaaagggatataaagcctggcgatggcacgggctgtgagtttagttcttcaactttgaaattcatattcatattcgcagatcgttttctttgtcttgatttcacggctgatatacaagcttgattctactcttcgatcacattgaatatatccctccatccaatcgaagaatattgaatccaacaaaatgcctgtcggacctcgagtatccaaagaagaattcatgcatgcattgggcctaaacccacaggatccgcatcatgagcaatactaccgcgccatgcgagtaagtgtgccagccgaatctttaacacttaccttcttcccttatattcctctccctctcccatctcccatatacaaatacaccacagatattcgaaggactctctaaccccaccccaggatgaagcaattattgtctacaaccgcatgaacgccgatacctccaacctgctggacaacgtgcgcgccgacccagcaacacggccccccttcttctggcaccatatccgcccggactgccagcgctgggggatcctcgagatctgtcacaatgcgccgccactcgtgcgcggcttgttcgagcgcggggcgacgaatggcgaatacgggccgaattgggtcgctgggtggttgttgtatagtgtttttcggtctcgggatgtgaggaataatcggaataggaggaagggggaggttgggggtgctggttcggagtctggtatgtattacaccttctttttggctgcttccaggtctattggtgaaggtggtgctgatatatgggtatagataaacgtacgaggccggaggagacgacacagccgaagaagtactacgatcctgtgcgcaatggcacgctgtgattttttggaattgaaggtgttttctagggttttgctttttgtgctctgctttttgcttcatatccatgctgtttaatatcttattgtataattgaagtatgaaactcttaagactatcgatgcaatgcaaaatacatgcatctaggtagaatggcaagtagatcgaaacaatcaatcgtcatcctcgtctttcttatcgcctgaatccttcttcttctcatgctttccacgttctgacttcaagacctccgtcacacgcttgtcgtgctcgtcagcccgctcattccactcagcatcatactcagccgcgatattcttaatctccctacgaagcgagttcccctcatcaatcaaggactcccagagctgcaaatcaacctgatgcaactgataaagcttcttctgcctcgcactgatcgtaaaatccagcgcagacttgtaagaaatctcccgattgtgatacaaaaaccacaagtaaccccccatcaaggtagacaaactgaccaagtaagtcactggctccatagtatcccacccgagagaagtcccaaatgtcaacttataaaccgtaaaccaccaaatggtaagaatcccaaatccgccaatcgcaacccgctgcgcaccccgatgcgccagcgcatcacactcctctttcacattcgccatggcctggatgcgtcgcgagagcttgcgcaatcgcatgcgcaggtaatacgtgcgctcgttgaacgacggcaccgtgacgcggagctggcttagaccggacggcgcaccttcgatagacacgataaactcgcctgcgcgcgctgcatcccggatgaagtcgcctatctctgtggcttgtgaccagcgcacgaagcgctcgggttcgccgtctcggggcggaccgccgttcgttttgcgggggtaactgtaggtttcggcgtcttcttctcgggatcggcggtgctgagtcggtgagcggccgttgaggggtttgctgccgccaacgccgtcgttgccggggacgaagtctgtttctttgttttggttttgcttcccttgtaggtcgatctcgtcttcgattcgttttttgggcttgatggcgttgtcgtcgcgctggagtgcgatgaaggagatggctggtgggcgaagattgccagtgttgcctttgattgggggtagctctgactggattagacgctctaggtatgatagtggttgttggggatggacaaggatagctatgggttcgatttctaatctggcagttagcataatggtccaaagaattatgttgtaggtcgacatacctttatcatggtcttcatttatgatggtcgttaaaggaatgatcagtttgaaaagccgcgatggcgtcgtcaacattttacctatttccaaaagtcagcattgatacttaaccaatgataccaacactttcttacccttggtcatcctttcaggccacttttccccttccatcggagacttccccccttcgccattctccccaggagctgcccgctgaggccaagctgcttgactgccctcctgaacttcaaacttctccagaagctcttcagtcttctgcttgtcgcctcggagttgtgtatggtctgcactgctgaatttccttgcctggatccaggcatgatggtctcgtggaactgcagtcagcccagcatacagcttcgttgccggtgatgcaccagaagctccgagaccaatacccctgccgaggtgcctccccgagaatgaacggatatgtctagatgagccgacagagtgattcccagcccagcaattgagccccgccgaaccaatccttcttaacgaggagtacggggcactgcattgtgatagtgatatcctccctgtcgccgccgacaacacaggggcgcaattccgtgccggaagatgcattttaaaaaggaaaggtctttttgtcctcccaattggttattgtgtatgttcacgtcgcatgtaaaatgggagggaatatgtagactgtaggaattgaataaggttgtattcgcgtaggagactaaggcatgacgaagcggcgtttttgagcacacgtgtggagaatggggaatatgatgtaggggtctaagagtccaagcaagaagccaggataatgcacgtacaaaaacacagctcattttccaagcttgtcaagttggcctggaatatcctgacgtcagagatgtgcacggatcggatcggcactttgggtgtggctcggtttgtggcagtgctggatctatatctcatttaggtaccttgtcatgtctttttgaatgtttcttttagagtatgctgcccaagtctacgagtggagtgcagtatgattattcaatatccttcaatatctagattagaatctatgtagagtaaccagcaatctcagagctcacgcatgatatcttgcacggccttcgcagcaaatcgtttccgttcgccctccggaagctcagagctcatatctaatagtcaaagttagtaccaaagtcaactatagcgagccaaggaatcaagaatcatacctttcattgcctgcatgcgcatcattaatgcctccatgctctcgacatcaatctcatcctcgccatcatcatgatcagagtcatctctctcatcgccatcgcctcctccacgctcaattgccattcgcaaaccgaacatttcgcgctctaattcatggacctcatcaccaaacccacgagagctaccaagacctaatagttggtcttgaagatcatcctcagaatccatatcaggatcatctccgtcaaagccagagttatctccagccatagaccagtcatgagtctcaagaacctcttttatacgaggcataccttcacgttctagtaatggcataaagtcagctaaagtccaaaaccttgccacccaaccaatcagaaaaccttgcttggtaaactcacccccatattgattcctcgtctcaacctccgaattctccttaggatcccactcaacaacctcccaccccaacagccccatatcaaagaactgatcctcccaccacccaaccgaaaacggcacagtctcacccccacctaaatccccatcgtcaacaccaagccccagatctgcatcgggatccttggatccttgctgacgcgcacccacacccgcagcacccttcctccccccaatcaacacaaacacaccaggaacatcaccgagtccgccgcgctcctcgtcaatgcgctccttgacagcgccaataccgcgcatcaggtcgcgcagtgcgcgcacgtcgggccgctccgcggggtctgtgtctgtattggagcccgggggaggtgtcatatcgctaggagtgtgcgcgcagacgacgagagctccaacagcttcgcgaacaatctcggcttctgagcttaggaagtcggttttccattgctcggctgttggggttggtgtcgagctaggctggggatctgtgccgtgaatggcaagtggaatctcgtcaacccagacgggaacttctgttgtgtagtattttgtttcgagccgaagagggctgtgggttgtatagccggcgaaggtgcttgtcggtggtgggggtattgagcttgaggttggtgaaggggctggctgctgtggcgggtcgaggacgggcacgccggttagggagtgtaggagcggcggaattattgcgagggattgggaggttggtgtgagaattaggagacggcgcggattggagatattcttcactttggacttcgcggagcttgcggggttggatgcgggcgctgaatgggtcatgatggcggtttttctggggacaattgggagtttgagattattcttaggagacttaagtcaggtggtgcccggtccagtccattggtagtgtttagtcggagaagacagtgtattgaggaggctaactctcccccgcatggacaaaaaacaagtggatagataatatgaccggataatgcctgactcggactttcccattttggggctcaaatcttgccgctttttgatccctgcgtaaaaatgagaacacccgacttggtcacgggacattagataatcaaagtgtgcttccaccaaggtttgatgtataaatctacaccaccgtttcaaggccagtcaccctggcttcggtattctattctggaggataatatgatgctatgaaaagaccgttctgagatgaacagtaggcccgcaggatccatacgattactacataagattagggagtgtttcgtcgtgtatgaaatgtccattctattgctcaaatgactccaatccgatatctaattaacattcttctgctcgactcataaatttatgcttcccagcaacgctcttcacatgagacctaccgagttccaagcattaatccgcaccgacgttaacagcaaatttgctgtatttccgaattctcggcccatacacataaagcaagtacgggattgcggccatggcagtactgatggcccccaagatggtcagcgtgtaatgaacaccgatagaacggtaaataggtccaccagcaaccgtcatgccgcctgcaaccacatatctggtaaaaacaaggaaccccaatgcagatgctgagtatacaccataggaatctatgatatacatgtacgcggagacgaaaatagcagtaattccgtatccgaatacggcggatgcaatgagaggagaccaaatcgagatggatggctgaacatcggcatcgagagtgaaagtcagcgaatgaaacaataatgaaccagtggtgggcaatggtacttacatagctggtccaacccatccagaacaaacttattggcactgctggagcaccacccagcatggcataccacagtcgcatttcaggagcaatactagaagtcttcttgtactctttggcagtccaagagtatactaccggaaccaagaagctaacaagaagaattccacatagcatcccaacccagagtatgctagtcatctgctgtgaaagcccatatgtatgaccaaaaacgtatgtatatccctccaggaaggtgaagaggacaatatagacaacggtaaggtagagcgacatcaagatgataatcagctcagagtaaaccagcgcaaatggccgatacaccgaggccagcagtcgcgggcccagagcctcgtttttcatctccatcggagctttgtatctcttgtccccagtttcttcacggaggatctttgctttccaatacagaaggagaggtccgtatgtttctggctggaagagaagaacgatgacaagaatcgcacctcccataataagcattatccactcaagccaacgccatcctagattaacaggaatataactgcctattatctgcccggccatcggtcccagaaatgatggaatagcataggctggaaaagcgtatgtcttttgtactggattccacaaatcagctactgtacctccggcgcagctgagtggagtagagccaaagaaaccagcgagaaaacgaaagatcaggtggctgtgaatgtttggggcgagtcccgcggccatgataaaaatcagaaaaaggaccatagttatcaggtagacggcgttccggccaaatgtctcggagaatgggcctgaaaggagggagccgctcccaaaaccgaccagaaatagagctattggcacagtcagcttgtggaaaggtgatagtcatcttagaggcctgtacttacctgtcgcaagagatccgactacttcggatacgttgaagtcttcactgtattgtaggataccgcaagcatcaatcgccgatgtggcggttacggaaaaagcaagcaaagagactagaaaggtcataaacaattttcgcgacacgctctgacttgcaggattcaaaggatcatcttgaccatcccagtccacaatgataggggaatcgatgggagatttttcctggagcgagaactgcttcggcggaatagaaagccaaacattgcttgactgacagctgtataattgaatatgagcatggattgcaagatatatatctgcaaggcttcgttgagctatcacttacgtcgagctatgtggtgacccgggtgtataggtctcacagctgcatttttctttgatttccgctagttgcccacgaacagctcgtcggatacgttgatattgaaagagagattccattgcagggaaataccagaagaccggcaatgaagattgtggaaggaaaaggcccgggtagtttgcgattatacagccataaggatttttaactatatttgagctgtaaagataccggctttaaggctttacgcgtctttttttttttttcattttttcatttttcttctctcaatgataatatggctgtggatcgtggcctagctccaccgataaatcaattttgtccacttgcaccagcaaagtccgaatggatttgatcttcgcatcggacataggtgggaaccgccacacttttctccgatagattgtacttcaatcccggccctaaatagtttcgtccgaattgcatcggacttccatcacccactacttctccgtctgatcaagttcttgatgatattatatatagaatctgatgacctgtggaatggaccaaaatgacacatcctccacttctgacttcaacagttgttcccccaatttccactcgagaccttttccttaggtttttggtatagtagctaatgtcggggggtaatattttaacaaagcgatatacctgggtataaccgacggtagtttgcagagctctcaatctccttaggggtaggttgaactaaactgctatctagcatttaatccagctaacaagtgccttttcttgaattggactgagcgttttggtaagatcggtacgatcggaatgagttttgcgaccgtgaatgcgtacaatgtcgagtacaaaactgagaattctcgtgcacggccttttgaattccaccttctgaattttgggcttttttaggcatcgtattgtggtataaaaatgggtaggaaggtgatgcaaaaatgaccaccgggtggtaagacggccaactagttatatcatactgacctagtcaggtagcaacgtattattagctatatagttatatatctcctaaggaaagcctgcattttatcatgccattaccctaaaatttgccttttatcgccatcatgttctacgaagacgtgctccctcctaccccaaaatacgagtttaagggagtgcaggattgtcttcagattttagatcaggaagtagagaaatatgaagggaataggtattcatctaacccttatattatttttattgtggatgagcgtaccttcttcgattgttttgagaaccccaaacaaagagaaaaactactcgcaacatcagtcaaagcctacgaaccttctaccaaccacttgcttctcgagatggagtcccctgcccatgcagcagcgcgccgagcgtttgaaagaatattcgaccgttggataggagtcgtctcctgcgagattagggccgatggcagcccgatgaattatagagggcctgggggtaagaacaaaaagccagattcagcattcactccgatccgctcaatcctgaacagacactggccgacagtcgtcctcgaagtcagatatgccgagactcggagcgaccttgaaaacgatgttaaattctggttgatccaagctgcgcagaatgtcaacgttgttatttctgtcgaaatattcgagcctgctggaagggtctccatgaaacagtggaagatgggagaggccactaagcgtccgttcccttgtcaacagatggagttcgtgcgaaagcctgctccaaaaacggagcaggtcaccggaagcctccgggtaccattcgaagatgtctatcttcgaccaaagaaagacggggagactgactgggtcgtcaccgcctcggacctcgattttatcgccgaaatggtctggtctgtgctctaagctgacacagggattcgacgagctcatctcctgtgttgccgcagtgaaccctagaacggtggtcgtcctcaacaacgccgatccagttctgatgccatggttagaccaggtctcctctgttctgtggatgggcaatcctggccaagaaggcggccgtgctacagcagcgctgctctttggggaccacaaccctgagggcagactacctctcacgtatccgagctcagttgatgccaccgtcaccagaaacccggcgtatccggagcgcatgaatacggaaaccgggaccgctttgttttccgaggggatgaactcagcttatcggtggtatctcagcaccaatacaagtatcctcttcccattcgggtttggaaaatcatacactcgtttcgagtacaaaaacctcagaatcgaaagagatcggggatccagcttcaaggtttctgttgatatcaccaataccggctcccgcactggggtggacgttcccagtccacatcggacttcctcaagatgcaagctccgaataccccggggtgcagtttgctgttttgacccttgtcggatttaatgacgtggaaattacgccaggggctactagaacagctacattcgaggtcactaaaaaacagctcagcttctggcgtcaaagtgataggacttggaacctggcccgcggtaaacgtgatatttggattggctctgacactgaaaccaaattactggaaggcaaactagatatctagaaggcataatagcataattgttgacatacatgggatgcgtttgtctctgtgcagactgagcatttgcctagtttgtctcgtttgccattctcggaggcttcatatacagcctcctgtccatagattcatcatcacactttactttctccttcatatccctggtagcatgtagccctcaagaataataagagacaaggtctcaatagtattctggtttacacatagagaaactcctgtccagcaatcaacttactcccccgctggatcatgtcctctagtaatttagagtcaagaacatgtgtcaggtgaaatacgtgaaagtattagattgacttgtaaaacaacctttgtagagatttccagtgcatagtcctacttgcagcatagtactccaaagtgcccaggtgggagaaagcagtaaagtaagccaattatagtggtgttgggaggaacctctatgccatgtccattgatggctggcagacgctattcaacattttggtatgatcgagctgggtagaaaatctcaagacgttatttgtcttgttaaacaagtacaagacaaaacaacagagaggcaaaactaaccttggacggcaattcacagtcagtttataaggccaatgcttggtgctctcgatgcaggctacggcactcagcaaatattctggaattcattggtcggacgcagcaaaggaacgattagttgcatgttgctatttaatattctctctgtccataactttgttattttaaggactacccacgtctaatggaaatgtaacgtcaaactacaggaatattgccaacgttatccaagttctaaacaagttagtctcaagtcaagaaatcacagattgcatgtcttacccagttgaaaagatccgccccaaaccattcccgcatatcagtccagtcttcgattgtgctctcgcaccgaggtcccgaattcggtagttgctggttttcaacgccgaactgagttctagaaaaggtcattgagccgaacttgtcatcacgatgaggtataacttactgtaattgaagaagtaagcgatgtgccttcaaacatatggcgcttcgacgagaaaggttctccattcgaagtacgagcttgttcaactcttcccgatacaagcctgactcaaaagacggtgacatatctaaaaggcacgagttaagagccactgcagcatgaagtgcctttaggcttgtaacacctctaagtaaccagagatagggtcgaagaagtggaacttcgtagatctgacgatggatgcctattaaggcggcactggaagctatacacctctccctggatgtggcaaggaagtgtggtgaccgagaatggcgaaaaggacgatgtagaagaaggtaaagttgatgtgcgtaggtttgtagaatgcaccaatatgcgtaactggagtctaatatgtttggagcaccatccactaaatatgccgagtcccatctctgttgttcctcggcgattgttgcatcaaattcgttcaatggctctatctcaagtcgcgagggaccagatatgtggtgacagatctgcgtggagatccggaaaagctggactttgaacatcatcacggacatctgtgtgggtgcactagatggtcgcgagatcccctcttgcgtaatatcagcatcgttgacatccgcgggcattgtggtctttatatcaagtaggaatgacatgtcgatatcccgaaagagaatggcttggtaagtatgtagcgtcaagataccaacccagcagcgtcgacgtctctcagtctcgagatggttaagtccctgggaatcaacattgcaccgtagggctatgccgatgtttaacgccatacccaacaatgcccatccttgatcgacagactcattatgggaaagattatatatcaccatcagcaaggcctcgaatgtgctgagtttatgtcggataaaaaattgatcttgtgaaaggcagaccatcgcagtttgctgaagccgacgggacaaagccacagcctcttgctccttggagtcagacccttttggccataaatcaaccagtctgggatcactgggctccatagtatttagtgtcaaagagcacatggaaaatagtaaagccagccaagagagatcaacttcatagggatgttgcatgaaggcaacatactgcttctggaatgttgggccatgtagaatggggaacagagccgagatgtgattgaaaaaatgagaaaccaagcagtcgcagatggttcgagagggtaaaatgccgatgatatcttgcagcgagatactagggccaattgaaaagggagacaaagtatcagttgctgctacagcatcatgctccggaaacgggcgttgaagaaccgcttcccagcggctatcctgggaatcttgaattccatcgggccccggccgctcaggtcgatcatccaaacaagcaagatgttgtctcaatggggccaagggagcggcgaacgtgttcctggttggcacatttgacgatgaaggattagacgttgttggatgatcgttaatggacccggtcacaacactgggggtggtcaagaacgagcaagacggcgcgcatcctcgccgcgtacatgcagcgcaaggctgtttacgatcacactttaatttggagcatcggcactgctcacaactaagaacttttcgctttcggcgatgagatctcggactttgcgctcgactccgaccccggccccgcccgtcgtgggttgaggggctttgactcatcgtattgcagtatttacctcgtacacggagttggatgtccggcacgcataaagataaatcgacaaggttttcggagaaaggaacagtgagaacagtgacgtgacgaatatcggagttagaggtgttcggagaaaacctaacatctccgacgacactgcttactaaccttttgaggcttcggagttcttcggatttacccaggtggtttatcggagtctgtctaagcgctatgtcttcccgaggtcagcacgaagtatataagcgctactatgctcgcaatagctctaagtgtaacctacttcggattagacatatgaaggtatgcatacatagatatagatttgaatgctatgtagtagtgctagagcaggccactaagctttgactaggcaggctagagctctcgtctaggaagaccagatcgtcggagtggctgctattgctatttgggacttctgttgctctactcttcgcggcttgtgggagacggataatcacgtgatatccaaactttagcccgaacctgagcgtcctcataaaagcggcagcttatatggatgtagtacttccaaatttgaatttctaagctcatagccgatgtgtgctcttatcttttgcttatagacattgagcagctagattatattagtgtacaatatacctgaaaactcttgctacgcataatatggtccttggacatgagcctcgaatcaatatcaatctcggatgggggtctgatgggggtccgtgggctgaacatacagacacctttagacggaaccaggagattcatgtgggtattgattcataatttgaatggtgatgtgacggagcatctacaagaagaaatgacagccggtattttaggacttcgcaagatcaaagcccgaaaaagaaattccctgagaaccaagaaaacaaagaaaaacgccaaccactcttgaatttgtgaggccttgaaactgcgatttccatctcttccacaaatcatttaaccccggccgcgctggccacgcgcacgttgcactgtagccttaccacgcgccaaaccgacaccgcgcccgcgctggcctcgtgtacggaacatgggagcattcctggaagtgagaagctaatcagtaaaggtgaaaacagagatgcgcagtccgccaaattgcgattcgaagactggatatcagggtttgacgtaccggagcatgtcaggcacgatgaagaatcgcacgtggctgccgcgaatgtaaacctggtcgagatgggagacacggccatcgcgggcagtgacggtgatgtccttgagctgaacgttcatgttgtcctcggctgtaaagaaaaccagtcagtatggaaccgcgcaaaagaaacaccccagaagcttctgtacagaccgcctctctaaatagagaacagacgcccaaaagctcgagcagcgatgagcgacgtaccttccaaaagcttcccccggtagacgactcctgatgtgatctcaattgtcacgacatggccctaatggaaaacaatattagcccatctgcctcgcgctatccacagcgatatccattttcgcgatatcatgcacacatcctgcccttccgtccaataacttgaatagcaatatcagggaacgtaacgcacctgcgcttcgttgaggagcttgatcgggatgccgatcgtggaggtgagcttgcccattttgactgtgtgacggcgaacgaggatggaaaacggttaaagaagtcgaacagaaccactgacagcttcccttgcaccaaagaagagacaaatcaaggcaatgggtggtcgcggggagatggtgggacagtgatgaggtcggagtaagtggaggttaagagaaaggcgaagagtgcctcattgcctaaggcagtgcaaagcctgcaaaccactcgggacgacactagcacatccgctttgggttctctatcccgaccaaacaacaactccaacctcaaaaaggcacaaaaactcccacataatgcgtgccgaatagccctgtctatatctgtcataattctacataatccgaaaccaaccgtaatggccggctcacccaattccaacctacgcggcttcaaccacgccgtccaaaccctcctcaaacaaccaacccaattcctcccacacctcacaatccctaccttcacccatctccccgagaacctagggccacacctgatcaacgcaaagaagggatcccaagcgcaaataccaactcccgaaaaacccccgcacacacccacaatccgcgctctggtcctcgacaaagacaatacactctgcgcagcgaaaacaacatctttcccaccgcagatcctcgcaaaactctcctcgctccgcgcctcaccaacctccccctttaaccaaactacgaacccgcactcaatcctgattgtctcaaaccgcgccggcagtcacccgcgcttcgacggcgaaatctccgcgctggaagcgcagcttgcgcacctgcgcattcctgttttccggctgccggccggcacggaaaagaagccgttttgcggcgaggaggttgtgcagtggtttcgggagaggggcgttgttgattctccgcatgagatcgctgtagttggagatcggcttgggaccgatgtgcttatggcggggatgatggggtcgtggagtgtttggtgtaaggagggggtgtttgatgttgggatggaggggaagccggagcggaatattttggagaagatggaggtttggattgagtggttccttcgggagaagggagggtaccgggcacctttgccgatggggtgggagaagcacaagcagtcatgagatgtgggatgctgggtttatataaacatttgagatacccttgttatagtatgtggttagcattgtacaatatagcgagactgaactatggctacagtctatacggagttttgtacgatacaaaatgaatttattcagggcttagcgtcaatcctccacactcgtataccgccagctcagcgctgtcctacctttgtggtcttgagcagaagatatcacaactctgcgcagcccagaggatcagcgttggttggatgtcagacccaaacaggtgccgacagaacaagctcatgtgcaaaaattcgactccagacccatgatagggaaatggaccattgtacccacattgagagtgcagggcagacacaaagtctagcaccagcctcgaagactcacagaaaagagaacaaaaaaaaagaaaatggaggggaatggagtcgcagtccaagtcggtctgtttggcataaccacgtaaaagagaaatggaaattgaaaaatggagaaatgggaagatgagaaaaaaacgagaaagaaacgagaaaaaatccggtcatgaatcagaaaaagaagattgaagaatgataaattgaccgggagaagaagaagataaagggaaaaaagaagtcctgtattcaaccgggacagccgggaaaaacaggagcaaaaagatcaaaaatcgcttcaggaccggccccagaatggaaagggtataatcaatagaacaagacacaagggtatgtcacgcaagaaacacatcaaaaggtaaaatcgcttccctaggcatcgccagcgagacgagaatcatccaaaaagagccgtgataaagggatgggttttgcaaaacaccgaaatccagcacctagccacgcctcttgatattggacaatcaagaaattcccccaaagtagaaaaaaccccaagaacccatcgcaagcataagcgccgcatgcgtagagaaggccgtgaaacatcaagagacaaaggagagacacaagctcaaaaaccccccagacgcctactcatgacccggttggcataccctgcgagttgatctcgtctaggttagccataccatgggagtaatcgcccatgccaggagaagggtgggcagggaggctgtgcatgggcagttcgaagctagggctttcatgcgaaacgccaaagttgacgtgttgcttcgagtacatatcattcatggagagaccgtcatcgaagccggtctgctggtcgtgcgagaaaccgtacatatcggacgaggcgtgggacatgttggacaatggcggtgagtggcttgcaatcagtgggtctgcagggctcatgctagagtaaggagatggcgcatgagagcccattgtcgaggcatcggtcgatcctcccgagacgaagggcacgttgaactgaggcgccatgttggcgactggggtcgattcgccttggccggcattgctgtacatgggactggcgaagtcgggaggcgatccggtggtcgtcgcggacatagagttggtgcggaaatccaggccatatccctgggtgtcgatgcgaaggtctgtggggagatggtgcactgactgtggaacgggtgcgtagatacctgcctcggtgtggttgaatgggggaggcgctggcgcgtggaaagaagacataggactctggaatgatgagaagtcaactgcaacaggtaccgaacggcttcgttggcgcttgtggccacgagcagctggcatgttgaagcccaagtggttgctgtcttggtacagattcatgtaagcgggagcggcgaactggttgggctgagatgcaggacgctggatgaatgggggagacatcgcagctggcacagcaaagctgctgctgttgttataagccaggcggttctggaaggactccaaggacacgagcttggcaagctgaacgctcaagaccttgggatggcctcccaggtgatgaaccatgatctgactagcttgctgttcctcggtgaaatcgccgcactggtagaaacctccagagttggacgagtccatgtaaaagtgcggcgggcggttcagttccacgacaagaccccctggtcgaggtggttccccattcggcccagggcttggatcaccggtttccaaggtgatgttcttgatataggcgaaaggatactcgattttatagccggcagcatcgttgttgatatagtaagtcatgcatgccttatcaggggagtagaatacgaccaagtccatggcgttttgtccaatgcgccgccagctgccgacagtcaaggaacgacaagtgaagtgagaaatcactagatacaccaattagtctaggagacgatggagcggatgaagttgttaaacataccaactttgccagaggggctggtctcgtttgcgtacatgctaggcgggccatatgctccagcacgtccaaaggggtctcttgcgccaggcttgttcgggtcaaactgcattgcgagatagtgtcgcatggattccgggatagaatcgcatccttcgccagtctcaatgctcttttttgcaagcatcttgattttagcacgactgtcttgagtcagtacacataaagatagagacgatcccgactaggacctaccgattctggaaccagatttgaacagatcgctccgtcatattaatgtccgaggcaatacgttctctggtagcggcagtgggtgtcgggttcttgttaaattcgatctccagaaggacaagctgatcctgggttgcgcgttgacgtttgttatttttctgctgttgagtcagagtgcttttgcgaggaggccggcgcgtagccgaagaattggcggtggtagcactcgaggtcgacggagagggcgtggaagctggaggcgaggaggacgatgccttgggcgcaattgcaccggttggcgggtaacgcatttctgtcaacgaagacataatgtaacgtggtacggtggaaatatatcacgcaatcggaattgtgttcaaggtgttcaatatgcttctttttttttcggtggtgtatataggttttgttcggaaatagaaggtatgatgtgacgatccggccgacaaaaaaatgagacggatgtgattgtggtgcggagacggagtgttggaaatgttgattctctcaaagcagccgcaggcgcgagagggtcaagttcaggatgtaaatgaatggaagtctagcgtagggatcgaatggcgttcgagggcgtccacgtcagagactgggaggttgggttgaaagggcgcgtcgcagaggcgtccaaaaaggagtggataaatagaaaggctggcctaagcagctggaaacgaatggcaggggaataatttctccctatatcgacaagaatcactgaagaatcaatgaagatgtttcggcaaatgctcaaatgcccgggttgaatcgatcaacggggcgggaacggaggggtgcaaaccgttctcgaggaaacgaatgaattgggcagaaatgagtgatagaatgtcgccgtgaaagaatgaaacggacgccaaaaagaaaagaaaagaatggagggaatgggaaacacaaaaagcgcaggacagaaagcggatcaggagatgggagatgctgactacacatcgatggacaacgcaccggacctttctggactattggcacctcgtgggggccccattgtattcttgggtcagggcctcgatttgtcctttttttagttttcttacggtttttgcactttctttttcttcctcttctatgcggttagaccgaaaaatccatggatgtttctttttttcttttccatccgggtccagtgtatggtgtgtatgtgtcgagtggagggaaaactggtttgggcccctgcgtttgcctgcataagcccaaccagcatcacggaggcttggagcaataagggcgcagactgaacctccattgttttggagaggggtacgcgtgccactccccttactcggcgtctatgtcttccttgtccaactacatcggtgtgactctccctcaggggcaagtgtacggagtagttcagtagaaacgaatgaactacacaagcctcatcgctactagtagaatgccgaacggcatccacgtgagatcgaggaatctgagacaccatcagccttctgagacaactgtcaggatgtcaatgcgttttgacaatgtgtttgacgaattaacgaggtggacggagtggatgggcgatgtgatagaaagtttttcccctggagactgtttcccctgattcgagccacaggactattgaaccatggttccaggggctaatccagtggactcggccaataagcatgcagttacacgtgcagttccgtggaccgccaaaggagaaacattcaggtacccgccccggcattggttatgattggttctagagacatgacatgtcattctagaccccgaaccccgaccggtattgaatttagcgtgcaactctccttgagactctccgtcacatccggttttctgatattccatttagggaggagagtatgaagtacggatcatatgatataatagggagtataaattcaacctggaatgtatacaacagcaataatggatgtaagaagttgtgcatcgagaaccccgaatttatgaatccttctcaaaaccggggcattcagcctattccccaaatgatctcggtctactccggtccgcggggtttgttcctttacattattttgcttccgctactgcatgcagtgaccttctagtttaataaccccaacacaggtagtgtcctatcttccattgttgacatgcgagaacccgggcattcccatctaggtaaatacccctgggacagttcattgtttcaattttgatccgcgaaccggttcatccctaattaccgagggaaaagagaacaccgccccctaaagatccaaaaatattaacttcgttagaagatgaagaaacaagcccctctatcaagcgcttggacataactatccacaattgacaattcagttcccctcggccaaccggagccactaccaaactctcgtagtttatccgtagtttgccagatctgctcaataagctccattgccgagttccgctgttgttccctataataagccgtcatagactcatgcttttgccgaacccacacacgatcctcgggcgataaggcctccctcgcagcaatgtaaaatggctgcggcagcgacgaatcaggcccacaccccgtcgatagatgatccattagcccaaagcatacatgtaccaaatgatgcacgcgcggtgagcacgtctgatctcgaaaaacccgacgggcaagcagtaaatgcgcagtccagtaaaagcactcggtgaggatatccagaggtgcgcgctcacctttcgctggcgggattcctttgtaaccggatccccacgcgcgaagctcggtgtcgagttggaatgctttattgagaatggcgccatcgtctgtatgtgtctcgaacgcctcgcttacgtcacaggctagatgcgctattcgtactaggaagcacattagtggctgtgggcatcctgtcatcttgtggaatgagggctcggtggtgtcccagcgattctggtcgggctggttgagtataaacttctgcggtgcgtatggccttcgctgtcgtgagatggctagcattacgtcgaccatagcgaatcgctgcacagtcatacgtgcgatggggttttgtggtatttcgtcgaagtagccaagtgcttgcatgagccaggaagcgcatttgacgtggggctccagtactccatctgccgtttgtgccacgacgatcccctgaagaacgacggctgtgaggagcgcttcttgctcgtacttgttactggttgccattgtacctacgtcgcaggcggccctgtcgtcgatactgagtaggttttgtccaagcgttctgagcattcgctgctggcgcttggctgcgagatcaatgctggttaatccgaaattgagcatatgctccgttgatatgcatacaatagtctcgagcagaattggtgatgatagggctgggatggagacctgccggtaagggttgtcaggtccatctacagcggggacattggatgagacaaggcttatgtctggcaagtattcgtgattagctattccaattccatggcatagaatgaggccacatacaatactcccaggcagacttttcttctgccgattcaaaatatgtctctacgaaaagtgccgaaggttgaccaagcatgttttgttcaattgctggacgaggatctttgcagcgaggcttatgtcttgtctgaattgtctcttttggttgaacccatttcagacccaatggatatctgcactccaaattccgcgaagcacagaacgagcagattggctgttgctcgtcacatttattgtgcttctttcgacattgcagacatccttttccgcatttatattagcacctgcacttcgcctggggatgagccgccataccagtccgtgatcgtgtgaacctgttgcctcgaggcatttggatgatcagacaaatgatgcactactggctagtgggagatcgacaaataatcaaggtagtggtgttatatatccccgggtatcaggcaagttccccgcagccttatctatatggcagtcacctgatgaccgaccaattagattattttcacaagcgaaacaatatatattgcaatggcactactagaccagactaaatctataagatatgctaagttttgcgtatcacggcccatgagaagggagaatgtgggagttaatagtcgctagaacgaacacttttgaaatcgctacgaataccgcctcccacctatcagtagaccgacatattgcggcattggtttatcatagagcagctgaaaaaacttgagcatacacaagaagtcattcatcatcattagttaaaagtagaggtggcaggtttaactaagctaattgcgaggaggtacaatagagactacataattcgtagagaacccactatcccagaacctcctgaataacccgaacagttcgctcgactatcaaatcgatctcctcacgggtagtattgtaaggcggcgccaaaataatatggtcaccattagcaccgtcgataccgccgttgcccggcagcaacgaaatcgcatgtgcaggcttgaggcctgtcgcgtgcagagtccgagaaagcgcctgtgaaggcggatatggctctttcgtctctttatcctggacaaattccatctataatcatattagcaaggaataaaagtcaaccaaaaagaaaactaacagcccagaataatcccctgccacgaatatcaccaacatgagggtgactatccagacgctcatgaagacgctgacccagatatgctcccatcgcccgcacattcggtagtagatcgtcctcttgtataatctgctgcaccctatatgcagccgcacaggcaaccgggtgcccttggtatgtctgactgtggacgaacgcgccggtgcccttgtttagagtatcgacgacgtgtttgttgatgagtaacccagcgatcggggcatagccggcaccgagtcccttggcaattgtttggagatcagggacgacgtcttcttgctcccaggcgtggagagttccggtgcggcccatgccagacatgacttcgtctaggatgaagagtgccccgtgtcgctcgcagacggcctttagtgctttgaggtagccgggcaatggtgggacgcagccaagtgtctattgaaatagttagcacgtttagcatggcgggattggttgtactcacagcacctggcattgtctcggcgacgaatgcacagacagtgttggggccaagtctctggaattcatcctccagttcctgggctagtcttgcgacatagtcttcggcgctttcgttggcgttcattctgcggtaggggtagcattgtggcacgtggtggatgttcttcgaaagaagactttcatagatcctccgccgggaggcgtggtgcccaacagcaagtgatccgagggtgtttccgtggtaggacgacttccgagaaatgatgtttaccctctggggctcagggacgggcagctccgtgaaatactgaatggccatcttcacagcagcctcgacagcctcggtacctattgtggttttagtaaccaatcttggctcagcatggacaggtttcttacccgagctcacaatgtaagcacgagacatcttgcctccagtggagtctaccagaagttttgccaatctctccgcagcactgttggtgaaaaacatggaatagcagtaggggactttttttagctggtccaagatggcttcgtggacccgctcgtcgctatgaccaagacaggagacagctgcaccgcatgtcgcatccaggatctccaggtcatcctcggttagcaggtagctccctcgaccaccgacgatgttcaagggttcatttcgcaactggtggtagaggactccactagatgctttgaggccagtggagtcgacctgcttctcggaaggggtaggcactgaagctggtgccagttctggtgtatagtcacccattgtatggattgcgctcaatggttggtgtatgggaaggaaaaggatgaaaaaggatgaatcaagtgatcactgaagatgtttgatctggactgggactgtattgtgctgggccgataggagtcatatatagactgaccccgccatagccaagaattgaattgcagaatcaggacactaattctggaaaaaatagcccatacataacgccgtgattggcaagtcccgccttgtcgcacatcgtgaagttcatacttggctgcgataagctaatcccaaagaggaaatctttgtcggacccacgttcgttgactacagcatgcatgtgataggtcgaacaattcatgagactgagcttattgataagaagaatatgaccccggggttctgctttgacttcagctcgtaccgggtacacagatgcattggagataggaccgagggggatcggaacgacattcgagtccgaggaccgaccacagcacaaacagacattattgagcaatcagacgctgaagaacacgacaggtaaccctggaggtcacacgcgaacactatgatgcagctacaaaccaacaacccgtcagtcagacagactgcccctcattgatatgcccctcaattgttcttcgccatctcagccgaataaccggagcccagtgcagcacctccctcgtcagtggaatatacggccacgcacagcagggccatctagcaacggtgaaattaatcatcgtctcggacattatacttggtttgatgaaagggtcacgtccggtagaagtcatggtttctcagaatgtccttgtctagaagtttccttgatatacgatcacatttgacggaggtaatgtacaggcaaacatatatacaatgtcgaacgtccagcgttcggtagccaacatatattctatatcgtgatcagggatgtgcgatggccttgaacagatctacaagagtcctccatggtagctaccatatcttgcagcggtgtcacatatattctacccaaagttagtaaactcgacgaatgaatagataaggcaagaaagattacatacctctcgtctgatcctgaagtcctcgtaaattcccaaccaaaggtttttgacgcggcagtcatcttcataaccagttgtcgggttcaactcgcagggaggctgtgattcttcgatcaaatctgggagagctctaatccatggctaccgaaaggagttagcttctctaggcgttattgacgggccgatgcccatttagaagtctgacctaccttaggcacaggccagtcggagaaatgcaaatatttagcctctttgaagatcttctctgcatcccatttttctcttgaattccctagatatgcccggtgtttcttggagcggaattccccagctagaagaatatacggccgatgcggtatagtaagtgcagtatccttgtacatgttgttcatgatctccatatcaaaggtgctagagttggcactagaaattgaatccatcgtgcgattgaaggcagctgtagatggttcaacaagcatgatagcaggggtgaaaagaccctttctcggatttttccagtaggctgagggcatggcaacggggctggacggcgccaggaataactcgtccatagtctgaatacaggtcagttcgcgtttgtaacaagcaagtgtatgataactgtacacacctgcagaaccgttgcatctgaatccaagtgaaggacccggtcataatctgttaggttaaacgcaagtagttttgtgtagctctttgaccatcccactaacggatacattgcaaagtcagcttcaaattggatttcaacagcagcaccgcgtgggcagaggttactcaccatcactcccaggcctcatctgtatctcgattggcttgagcttgactccgtaatggtctcgtgcatagtgaagcatgcggctttcactcgaatcaccgtcctcagatataggccactcggaggggtacatcaacatacgatcagctttgcttccaagcctatggagggtctcgaacagcatgaccgagttgcataaataagaccggtcggtggcatattggatgtacgcaaatcgcgaccagttgacttgcttcctggcaacagcgaggccctgaccagaatcgctgaaacagtccattgttcgaagttccagtaacgtaacaactcctaaacaggtagctacacccacaaagatggcgcgaaatagtttctgggatattgtggtcctgctcaacatgatcacggttggtagctccaaacagaatattcggtatttcacactcttttgcggagcgggtctatttaagggtgctctctaataagcccatcttggaaagcattgttaaagcggcccatgctaaggattccgcccagctagttcccacgggcttctttcaaagtaagtgttgggcatgatgtgatagacgttcatctttcattgtttcgttgtcactactgatcggcggtggaaaggaagggttcccaagggcgtatttcgacgcaagaagtctttgtcttctttgtctgtgtgtccatcaccaacttcaaaactaccttggcgctattatgcaagtgttgctccttcaatttcaagactagactaaagccatatgactactttctgtaagggaacttctacagtattcctttcctctatcacaaatagttgtttgtactttgcgatacaacagttttgcgcttggtactccatgccctcatgatcttgtctactaaccaataccatcttcaaaaagcggcctatgagcccggtgacttattattggtaagtcctatagtgctttgtagggcgtttcatatcttttgccgaatatatttttcctgtgtcggttttagatggaaaggtccccggattctataaataaccagccactcgcggcaggagctactttatttctttcatcgatggtgataagtgacgccaaggcctttctacatgtctttttggcttagcgacgaaagaggaatgacagaccaccgccgtccctatcatcgtttcaatctccgctcttaagttgtacgagcggccgatgtgcgcatccaaggggccgtcgggcaaagcgattggcaatcttgagtgaccccatgtattaggtagctagtacgcagcggtataggcgccagctgccaaaaccccatttccgggaaatattgatgccttaatgtctgatttgggcctgacttctgaccgcttcttataccgctctgtacaatgtaatgtaaatcataagcttgtaagaatgaagcctttgtctcccatacaaatacatgcatctccgatttttgaggtggtttaccagctgtctccctctagtatgacaattgaggcctttttctcccatacaaatgcatgcactctccatttttgaaggtggtttactagagagatatatatttgtatgggagaaaaaggcttcattttatagaatctagcgacagctgtcagactgtgtattggaataaaatacggcattattccactcgacacaaaaaccaaggtttttgtatatagcctaatggagaccatatccccgtttggcactatggtactgtacatacatcttattaaggctactgtaatagtatttcaagtatttcaatttttctgccggtcttagttcaggcctccaggccaaaaccaggcaataaggcatcattaattgtgggaaatggggttttggcagctggcgcctataccgctgcgtagtagctagcctgtagtatatggaatgcagacagaagattagagctaattaatcgtgtgcatatctagtaaatctagtaattgcatttggcgatactctcatctaccatatgtaaacccgcctctcgctcgaagtcgtcacaaatatttagacttggtatgttatcattccactcatagtcgtgttacgctagtggcaacacttttggcatcaggcactgactagaaagtaatccctatactatccttgccacttgaaatcaaccatttacattatggtgtcctcttctgacgcgggacaatgagttgagatgcaatcgttacttttgctatgctagtggttgctcttaacagaagttatttatttcttttttaaaatgcaatagtgcatgcattctgcttccccttgaagttggcccattacttgtcgctctcacacagaaacaatttgtaatagtcctgcttctagacgtattcttttgcagatactactagcaaaaataaattaatttgaggctttggcccttctttatgaagtatttccggaagcccttaatttccgcgccctgccgatcatcactgttcaagcagccactttggcatctgataagtcaggccagtccccgaacgtttaccgcgagaactttaagggctgtggcgttttttaggaagttacctcgtgttcgacacgttcccctctgcggattgcaattggtatgttgtaagtttgcgcccctatcaatcgtgcatatgcagacaatgagccacaataaggtcgtttaatcgcatacttccaacatggaattttcgaattattcgatcgggggacccgaacgacaagccaaaaggacccacagcgtgtaaatttaatatggagtactccgtactccgtaagtcatcacatgcaggaagaagatattaatgttgtgcaagtagtcttgttttgagatttataatatactccaggttttccatctagaaatattataagttaggtacaatatatagagcgtaatgcggctattacacacaactgttcatctattgatcttttctgagccgttaattcacaaacgtatgactgcggtgttagcacgggctcaagtacctgcatataacattgattaaaagcacattggaataagttgtgccggaatatcttacagtctagtgacttaatgtctggccgagttagcatgtgcctgtcaaatcaacaaagaccaatggtagcagtggggacaagcacgagttaagcatgccgagtagccaagactcttcttggtcgattcgaggaaatgctacgataaccaattggatcagtgatatctactctgcccggatactgaggtataaataatcgtctttgctctggttactcagtattttcgctcccatcttcaccatcttagtcccttcaaaatgctgttgccacgctcccttatagtggggcttgtcttctgcctcagtggcattgatattgcgtccgctgctaccgccaaacttcccatcgctgaacaatccgccgaggtcgattccgacctggcggctatttactatggttcatccttccaaaactccctgcttgtgggtaacgatggaggcgctgctactggtggcgttcgatctttcagtctgactgatatggaagaagtcgccagccgcacgcctggtcgtaccaaggttgctggtgtgatgtatgatgtggggaagaaagatctaattgtgtctatcgctgctcctgactcaatcattcgggtctttgacatcgatggcaccactgagattccctcggcgcagatcaaagccctcggggattggtcttctctgtgcacgtggcgcagccccagcagtggcggacactacttttatctgcttggaaagaaagaggcgagacaattccttgtccgtgagaaggactctgacattgagatccttgaggtcagtatcttaagcgacacacgtcttctgccgtactgcggatgctgaaagatatttaggtccaaagattcaacgtccctgtgtcagcttcttgtgctgtttctcccaccaatggtactgtctatctggcaggtgaggacagcagcgtttacactttcaaggccacagaatcaacgaaggcccccaaaatccaggtcctgggacaggttgatgatgaggtgacaggactagccgtttacgttgcgcctgagaccgattacttgttcgtgggtcagtccagtgttgtcaatatctattcacagaaattgcggctcaaaggtagcttgacccttaccggcgctgaagatattgaggttgctggtctgtctctttaccagagtgcttttactcagtatcctgatggaattctgggttactctcttgagacggatgctagcaagggctatggcattagctccttggagccggttttcactgagctcggtctcgaacccaacactacatactccccacggaatgttgatccctccctccagggccctcaagagaatggctttgtggacggagatggctcgctcgagtgctttaccggatttacaggcacagactgtacacagtttacgtgcccgaactcctgctccggcaatggaaagtgtgtcggacccaacgaatgcaaatgtgaggattcctgggcaggtcctgaatgctcctgggttggggttgaacccaaatacgagactgatgccaacggtggtgacggtgatgaccctgccatctggatttctcccgtgagtgccgaccagtccaccatcatcaccacaaccaaatcggaactgggtgctgggtttgctgttttcgatcttgccggcaaactgcttcaaacagtttccgctggagagccaaacaacgttgatgttatttatggcttcgagatcggtgatcgcaaggtcgatctcgcctacgcggcatgccgggaggatgacacactgtggtatgttattcaaaaacctttctttttcgctttcctttctgtttgtttcttcttgtgctaacatcactttcaagtctcttcgaaatcgcttccaacggaacgctgaaatctattcccggtggctcgcagcctgtgaaaaccgactacaccgtctacggctcctgcacctaccgctcgcccatcagcggcaagcagtatctctttgtcaatgagaagtccggcgagtaccttcaatacgaactgactgccttgaccaatggcacactagccaccactctcgtccgcacattcactggtggttccggtggtcaacccgaaggctgcgtcgctgatgaggaaaactccttcattttcctcggcgaagagccctacggtctgtggagatacgatgccgagcccgatggctcatctaccggaaccttggttgcgcgtgccggcgatggtacccttttcgccgatgttgagggtgtcacgcttctgccaggcaaaacaccagagcaaggatttgtcattgtctcctgccagggtgtcagtgcatactcagtgtatcgtcgtgctgctccccatgagcatgtcatgactttcactatccaaacttcggcagatggaagcatcgacggggtgaccaacacagatggtgtaaccgcagttggaactgctctgaatgccgatttcccgcacggtctgctggtcgtgcatgacgatgcgaaccaattggctactggagggactgctgaactggcatcattcaagctggccagtatcgcagatgtgtttggacaagagggagagactcttttggccgatattgatgcgacatgggaccccagggcataaatgctgatcctatagggttcaattgccgaagaatttggtgattgtcgtccgtggattatacttctatagatatgatacacttatttctctatcacaactcgggaaatctttacttgatgatgcatctcttcgtctgtttctctccggagattctgctgtaactcctatcgtatctttctggccgattttaatttacctctcaagatccttttccttacctaccaccacagctagttaaaacaatagggagaacacctgcatactactagtgtgtgcttggagagtattcagtcttgcatctcttgggcagaaggctagtatccaagccatagccaactggtcctttgttgaaatcattattgtaattcatgtatttaccactggacaccactaatgactagggtgtcctatacgagaaaaggccagtgtcctccgtagatcctttgccaagaaccggggtgactcactcacaacttcaccccggacaacgcaacctctccaggccaagtcgtgtgtgcaactttacccatcacgcagagcaggttaaaggcgtctgctcactggtttacctactcaacaagctgcctaaggattttcccaaacccagactttccccatcgagtagaatggcttcatcctccgtcttcccattccacctgggagagacatcaaacgaacgagtcaagctcacccccttcaacccagagcaacactgtgaaacgttcttccgcatatcgtcgttccatccggagatatacacacacttgcccctactacccccgacctcagcaaccgagctcaaatccctcttctacagtgattccacaaaccacattctatccttctccaacccggaatccttcgcttttgcaatcatagacaagacacggccgccgtccccagaagatcccgaaggtgaactagccggcacagtgagctttatccgcacatcgccaacgaacctgcgtacggagattggattcatcgtcatcctgcctccgtaccagcgaacccatgtggcgactaatgccgttggactcgctctacggcttgcctttgcatgcacggagaatggaggtcttggattacgcagagtgcattggtcggctagtacgatgaaccttgctaggccgaaaaaatggaatacgcgacggtgcgcgaaataaaaggtggtgctttctccgaagcggggagatctcggtatacgggtgccgggggtagcgaccccgcgggccgctaccctagctgtagggtattgaaaaaaaaaaggctcgcttaggctagagcgaaggacttataacctaatggaggtgcaatctagatggaaatggaatggatggagaaaacactatatcgattgacgatctcgcacgaggagaggaggaagagagaaggaaaggagagagagctatcatacatagaggttctatcacatagtgatgccttaggcatctaacacttgttcacctgaactggacatggatgtatccctggcctatatctcctttgcctttcgaggtagttttgggttacagaatactctatgggacactagggtttgtttataggtggaaatactatgctgacggttgagtatctggatcaacccgcgcgttgaggattggtttgatctagcatatttgttcctagacgtaaaatgcgagaattagacacccttccattgccattgggaactggaataggaaagacatcgtcctctaatggttgcgtatatcatccgagtcgatgtttgtagtagcacgtaagatgtcgagggattgcgtcttatcacgtaaccttgacaagcccaactctgccagcaaaataaattcgagactttcaatgtcttcttggccttgaagttaggctgagcactagcaaggctggtgcatccttttccaagcttgcatgaatcaaagcaaattgcgcgagtattgcgcaagactatcccgaagaatcgtcatgtccgtgtgctagggacccgctagttaaacctataggaggtaataaacattagtgtcggatttaacgactattctctctcctcaactgcctggtatcagggcgggatggttgtgggatctctcagtgacgcgattgctaggtccgctgaggacatatttcaccagttgtataattatttaaggtcgccgctacttattcacaccaaagaccttgtgcagtaatataatagtctgtacacaggccttactagtgtcaaacaaccccgaaagcacgatgggaaccatgggtgattctcaacaagtgacgaccacttcggtgtacagcacagatgcggagaatcagattaagagagataatggtacgaagtctgtcaggtcatggaaaagttatatatgggatacatgggaacttccaccagatcaacgctggatgctttttaaagtagatgcttacgttctcacgttcgcatctctcggatatttcttgaagaatatcgaccaaacaaatgtcaacaatgcctttctcagtggcatgaaagaggatctcgggatgtatggcgatcaactagtgactagtatgtgcattcgctctcgtccgacccgttttgctctgttctcccttacgtgaaaacccgggggatttgctaacgacttttacaggcacgtctatctggactgtgggatacgttattggccaaatcccgtccaacttgttgttaactagagtctcgcctcgatgggtcatcccctcgctggaggtaggatggggactcgcgacaatctgtacatcaagtgtcaaatcgtatcgagctctgtatgccttgcgcttcctcgtcggattctttgagtatgtccctattccaagatttcgactactattagttgccatttactaacgccgttatagatcaggattttaccccggcatccattacatgctgggatcatggtacacaccacgggaaattggaaagcgggctatgattttttggctcgctggttcggttggcaccttgttcagtggtttcctccaggccgctgcttatacaaacttgcatgggacaaatggttacgctggatgtatgtgaccgcaactcttggattctaccttcctcaccttttgtggttcgacccatggatcattcaagtgcttatctcagcccaaacgaaaatgaaggaaacaactgctgacagacgagaatagggcgctggttattcattatcgatggtatcatcaccctaccgcttgcactcgccgggtacatattctttcccaacctaccgcaaagcggcaaaaagacatggtggacgacagaagaagaacatattctgtcaatcaagagaatggagaatattggacgtgctggcaagaagccttggactaaggcaaaggtgaaaggtattttgctgagctggcatacttatcttcttcgtgagtcgtcctccacacctctcacacctctcacacctctcacacctctcacacctttcctgtcctagaaatatactgacatttccccacagcattgctatacattctttggaacaatggcatccctcagcccgctatgggctattggctgaagagttttaatgccgaccctgctcctcttcccgggacaacttacactgtcgctcagatcaataaccgtgagttcaactttaggctctacatcctaataaactcggctaattatatatacaagtacctctccccactaccggtgttctcatcgtcatggcattgtcctggggttggctgtctgatgggccatgtcgtggcgctcgctggccattcatttacatcggcgcctttacgactgtaagtcaacagaggttatgtcagttaggtggttttcatactacggtaactaaccccttccctctattccacagatcattttcgcctccctcatgatgaagatgcccttttacacaaatatcaagggccgtatggtcatttattggctaagtaatattggagtaagtttttccggtaaagcattccatcatcacatcttaacgtgcctctagggtggtgccggccctttaatcttaagttggatcaacgagatctgctccaacgacacagagaagcgggcgttgcttgttgcaatggctaatgaccttgcctatgtcgtgcaggctgttgtgagcctcgtcttatttcccttcctcgagtacatactaacaagtttgaccgaaggctcccaatttcatgtggaaaacaacggcgttcccccgcgctcccaagggatatacttggtcaatcgtacttcaaatactactcagtaaagaccatctctatgacaatgggtcttgtttcccgctaataatattttcctagtattgggcaccgcaactgttcaattccttttgtggcgcgataagggaaaagcagccaaggcagaggagagtctcccagctattgaacccgtcgagtcatcgtctatagagggagatacatcagtgggttctaaagaggacgatggcaaaatggctagcccttcccgggtccaaaatgtcggtctgggttaggggatatggttcactgaaggcactgttgctatatagttctatgatagttggcgtcgacaaggcatcagattcatgtttccgccttacgaatcaggccacgacattattttgtccaatgtctttccctacagaaactaacaagttcaagtaactagttatttactatcacggccaagtaatgattatccagatatcccccgaattccatcgcatcccagctggtaaaacccgtgcgaatcgggaatagcgtcctttccccctctgcgagttatgatcgcggatgagggctcgtgcgccaagtctctgcagcactgcctttaaaagggttggaatctgactgatatcaaaagttcagcgattgcctagatggtcacctgcaaggttacaccttagtggagaaggttaccgacttaagaagtacttaagtacttaggtatctcccacagcagcttcatggcagcaaatctcgtgacgatcttggaggcgcagatgcaagccgatcaagaaaatgtatattagccgaatcagcgcttgccgctaattccacttataagagggcacctgcccctcgtggcgtcaaagctcccctgcttccctttctctcttgactaactgcgccagcatcttctcccttcctcggaacttacaggagttcagagaaatattatccctcgctgccgatggattctcaatatcctcccgaatcaattgtccctagtacagcgggcaaggacaaacactcgacgaactcgttgctggcggaggagagatcgattcgaaatggagaccaagatattctgcagggagagaaggtggacgaggttctggctgccaagatgacgcttatcaatgatgtgggaaatcaatatccgcgcaccgtgattgagacatgcaattaactcgaggccctttgtcctctacagaccattgatgagattggtttcacgcctcaccactggaaactattttgcctaaacggattcggatatgctgttgactcgctcattctcttgattcagtccattatctcaacccaggccaggttggagttcaacccatcatattccacagggctcaccatcgcggtttatgtgggcatgttggtgggtgcaattttctggggcttttcggcagatattatcggccgccggttcgcgttcaacttctccctgcttttttcatcggtattcactatcgtcgcgggggctgctccctcttgggtcaccctgggtttgtttatctgcttaagtgcattcggtgctgggggaaacctggttctggataccacagttttccttgaataccttccgggcaaggaacagtggcttttgaccctcatggcggcgtggtggggtgagattacactcccaagtaaacatcctgtcgaaagtctgaactgacccacagtatctaggtctgggtcagcttatcgcaggtctctttgcttgggcctttcttcccaacttctcctgtagcgatgcagctacatgtactcgtgaaaataaccagggatggcgttatgtctggtacacaagcggcgcctttgtgtttgttctctccgtcctccgcttgacaatcatccgccttgaagaaacccccaagttcctgatttccgagggcaaagacgagcaggcagtacacgtcctacgcaatattgccgatcgacacaaccgcccatgcagtctcactatcgagcggcttgaggcatgtggacgaatcgctcatcgaggagccccaggatctggttggttggcgcggctaatctccccaggcgaagtactcttccatgtccgtggactcttcacaactcgcaaaatggcactatcgacgaccctggtctggctctcatggctcctcatcggcctcgcgtatcccctatacaacgtgttcctccccacctatcttgcatcgcggggcgcaatgtttggagagagtagcccgtatatcacctggcggaactatgccatcaacaatacctgtggcatcttcggtcctgtgttagcgggattcatgtgtcgctcgccctggttttggggccgccgaggaaccatgatcatcggagctgtgatcacaatggttttctttttctgctatacgcaagtgcgcactgcaagccagaatctgggctttacatgtgctatttccttctgtttgaacatttactatggtacactctatgcttacacccccgaggtatgtgctcgctcactctgattagatctgtcattctgtatctcattgctcgataggtcttcccctccgcccaccggggcacaggcaacggtgttgctattgggctcaatcggatcatgggaatcatcagtgccgttgttggccaggctgcaaatgtaaggatttattctttgctctcgtggggaaatgcttatatcgagaacagaccagcacgcctgtgccaatctacatatgcgcagccctttacattgtgatggcgatcattgccggagccttgccatttgaaccgtatggccgacgaagcagctgaaggctcagctagccaggatagcggtccccatctcattgatatctaagacatctcataattattgaccctcacgctactacatattattcataagcaatctgataacccggatagagcaaagtgttaatgctaattgaactggaggtcaagttcgaatttcttgcgtgggatattttattctatatgttcttctctgagaaggccacgagatgacatctgaataatggctccgtttcattgacttctcatccatgggtgtcttctttcctcggctgactgctggaatattttccttgtacgaaccctgatttggcctcttactttccacatcagtcgttaggtaccagtaacagttccccgtccagtcgccgacaaaatctgctcatctctccatagccttcgccgccattcctctcgctctattctcccatcgatcccacgccagcgtaagactcaacgtgtctctgcacaaatcctcagtatcacccccaggcggcaactccctaccatttccaaccttcccattaatcttccctttcacaaaccgcatatgccaaggtatgaccccaaccttctcaaaccccatcctctgcgcaagccgagaactactagagtatagatattttcacctatcataaattcgaaatttttaccgagtttttcacggggtttttcacggggttttttatcggggtttttattaggatttttgttaggatttttatcgaatttctttttatataactgtatacgcctatatactcgaacgtccgagtaccctttttatatatacattttttaactaataagaagtacgctagtgtatagtgtatagcgtatagtaagctagtactaaggctagagctaaggctagagctagtgccagtgcctatacccgtactagagctaggatactagtactagatactagcgctagatactagtgctagtgctagagctatatacccgatacctacactacgataatcgttaattctaatcacctccgtctctaccttcacgactaccggctataagagtagtgtctataatcctaccttcgcttaggagcgagtgtagtataaggtacgctaagattagctaatataaactagagggtttatttagtgtaagaggcacgctagggttaaaaggggacgggataaggggggatacagatagtctaacggtaagcttagagctttttgtttacactatatactagataggggtgaggtaggttctataagggggatgttagatacctgaggtatcactatatgatagctctctctcctttccttctctcttcctcctctcctcgtgcgagatcgtcaatcgatatagtgttttctccgtccattccatttccatctagattgcacctctattaacaagccactttgcccggtaagagggatagaataatcaccttagttgaactaccaagaactccttttatttttgctaaaccaaatctgtaatttcgtatctgaatgggtttgagaacaaaattacaaaatcctatgatctatataataagatagtcatgttgctgatggaaggaagaagctacgcagtggaatatgcaactcagagaaataaatggatggactctggagaggagaaaaagaagaagagagagggggaagctatctgcatacacatgaggaagtcctgggaagcgggggatcacgtgataagcacgtgaccaccccaacagttgcctctccgatccggagtcgcgagtctgcagaagtcagcaaaatatcgagatcctagttatagagaaggtaactcacaaaccacacccacggaatatttctactatcatgtttggcctgtctacctcgagcattccaaacagatttgagtagagaaaccgacatttcgctagaaaccccaccatgggaccggatatggtcgaatcgcagaaggagataatgccgagcgtacggggacaaagcatcggccccagccataaaaattggcataaccaccaactcgatcagacgacagtctgcagggatttccgctagggagtctaagattgcagtgaccgatttttgtattattggcgcttcggccggttgagccatatccagcaagcgagatgtgtgcagtatgcatgcgtgacggaaagcctcggcaactgcaggccagcggggattgtcgtttggatatctgtcaggcttcaagctccacgagtacaactcatagcggcaggcattgagaagccgctcgtattctgctgttcccattttgcccgtcgcatgcgccttggcatgctccatgacgttgccgattatcaagaatatctcgcgtgggcagccattgacccgctcgaatttcaagtcgcttaaagtggctacggctgcgcgaagctcgggggaaaagcatagtcgtcgggcgtctgctagtgagcggatgatgtccagcctggtaggatatgcgtcaggactaggagaaactggaaataagatgagagaacttgccatgctaggtttcctaagaaaaatatcgttctttcattctctctgcagagggtatcagacaagcgcaactggttgcaaatcgatagggcacccgtaatatgggctccgtgggtggatatgcccgattcgaaaatcttcagattcattagtcctatgttaacatcagacatcaaaaacgcaagattgtcaactcacatcctggagtaacagtatctgaataataacgaagatcccatcacgttcattttcatccagctcgccagatatcccatttcggagagtttccccaagacagcgtatagctctgactcgatattcaacggccagagtctctcgcagatatgtatctccttttcctattcccatatggcatgcggtaagacctagaacggcataaagcacgccaatttgttcgtatgctagcggcagaatataaacttgatatgggttgtacgcgccagctggaagagcgatttgatgtggacatataacctggtcatctaaataaatattttgcagtcagtcaagtaattcgacacccaggataaacaaacacacaatgtgccagcaacagctccgtccgttctagcattaacaaatcgtccaactcgacggatcgcccttccgactgtggccatggatggtcgagaataggcagccgttcaatattacgatcctcgcacgagggcaaagcacttggatgccgttgatcggattcagattcttcatggctggtatctggatgatcaattccggtgcccggctgagtccggacagcatggtcacggctcacagtagggaccgccctgttcttccacttgccccgggttgctagcccggcaaaacggaacttgtccggatatcctttgcactcaaggcctttggtgatgcatctctgacaaacgggttttgtgcggtcgcatttgcgacacttttcacggcatgttatacaagccgggcctagggtcgtcagagccgcatcttctcggtatgctcggtgtatatttcacaaacctcccgagggcatatcctctctcgcgtggtgataagaatgttggagagatatattttcctagagagtcgacctattaggatgaagagaaagaaagagaatggggtcaacggcaaaaagaaggccggtgataacgccacgtgacggtttacatggtcacttggtgattgtcaagttccttttctttatattattcgagatgacatttaatggagtggcatctttcttcgaccctaatcctcctatgtcatgaagcacaatggagattgtagcctgataaaacgaggcgtctcacataattctggaataactagttaactaagtcacccaatgtcagctaacttggccaaatacaacctttccttgctccgttgcttcatagaaatatatcatgaagcctttcttgaaattcccttcaatgtgactacgttttccctacgcgctgggattgactagcgtggcggcaagccactggggtctcgggagagtgcgtcaccaatgggagacgagtgatccagagatgcctgtcattaaccgccatgttttgaacagtgctaacatgtagaaatgttagtgttgtttcatatgtgcaccaatgacaacgaatattgtcttaaggatgttcgattccaagttgaactgagcctaaatacccaatgcatctctgtctcgacggaatctaagcgtgactctttcttcctttactattatacattctttattatatctctatcatgcaacaaaaaggacacctcgacgagcccaaacacttaatagtctcatcgaaaagcaccccatcaacttcctggatcgagcattttctattcgtcctcctcatcatccccttaacactgagtgctcttgtattatataccgatgtttccacctggtaccttccagataacctatatgcttttgtgaatacaaatcgaacatctgtccagacagcagtccagatcttcggcgcaatcctagcagccatcgaagtcttcgcactctgtcgcctaatcaacttaacaactcgcattcgatttacacaagccccagtctccctagacatgcttggcttctggtcagcactatccactccaacaaacaacttctgtctacctttctggatgattgtcatcatggtacttctcacaaacctatctgctatcatatcagcactatggaccggtgctttgacacccgcaaacgccatcggcatccaacactctaccgtatctattccagattggtccaatatcagtctaatcaaggaatacccctccgagatcgacaagaatggcctatccattcgcgaggcaaagggttacttcacctactcagtaggcatgggcctactaggttcactactatcctccatgaactccgcctcgccaaccgacggcggcgtacgcaatcaccccaaaatggacaacacccgctacaactatcacggccgatcttacggaattggcgcaagtgccggtctctctgacgataatctcgtcgccataccccacgtcagaaactataccttcaacgaagtcggcctcgacgcctcggtcgactgcatatacaatacaagctcgatgtttgtacttcaagaccttccacagccaaccctccacacagcccgaggtttactccccgatagcaaacccagcgcaccggagtactcggtctacgttggtcgaggcgacgatgcaatagttgcgttaggggtggcggcggaccccattgaatacagcgcaaagcgatacatggccatcgcggcagggagttactacaagaatttggataagatccagtgtgccgtcgcgttcaagccggcattattcaatgtctcggttgatattccgggacggaatatcagcgtgagcagagtgagatccgtggacgcggtccatgatatcgacccccatcacagtataacccacatcgtcatgcgacaactcgaactcatctccaacgatctgactagttactatcgctcgacccttggggacgcgttcaatgctagcattagtgattatcgcacttccgttgctggcgggaacgatagcctatcggagatgcagatcgtgatgaagggaatggagaatgcaattacgtccctcgttgacgatatccttggcgggtacgcgtcggctcaattggtggtcggtggattcaagaagtccgcccctgtacgggttgagatctctactttacgcatcgggtcgcgggcttatattattgccagtgcggtgatcacggggttgatcgcacttctggttattggggagggcattcgaatgcggtggtggaaggatctcccgacttttgattatcaggataatcgaggattggttgtgggtgcttctaggggtgggaggggtttcgcggagtatgttgagcacatgaactgtaaggatcttggcaggatcccggtgatttggaggaagggtaagggtcaggaagcatgggatcaaggggaaattgtctttcaacccttgctacatgactccgaagatgatattgagcatattgcatcggataggaattcggtcgcttggatatgagacctcaatggcgtataactgttgatgataatttatgatgcatagcgtcgctatagtgcattagacatgtatcgaagaacatctgtcaaatttctgaattaaaaataacgcgaggcaagaaatatgtacttcacctcaaccgcaaaaagaaaaggggaatcacacgtatgcaatagaacccgatatgtaacgcgaaaagaaagaaaaaaagaaaaaaagccagactgccaacaatgtgagtcggggtatcttggtatcttggaactgacggccgactgtgcaacagaccgaacagcgaataataagaaaagagagaccacggaattggacaatcccaattcaaaaatcagaccaacgcctttcgatgcccgaagggatcgtatgataagtgaatggacaggaatcgcagatgcaatcgctatgaaagaaaaagacggtggaaataacaaaaaaagacgaggggaaatcccgttatacatatacgaatcgaatcttcaatcttgaatcatttgagctgacccttgcgcacagcaccatagcccttactgaagagctcctggatctcaacagaacgccgacgcccattagcgtcttcgggacagagaagtccagactggcgaccacggtccttctcagcattgtgactcgggacgctgctgttatggctaaccgtcgcgctggcggtatcgacctcgagttccttcgtatccatgacacggggacgggcgagcagttcgcgaacctgtcgttcgcgggcatccatttcagccttctccgcgttttcccgggcgatctcgaagcttgatctcttggtgccatggtcccagccctgctgaagttccgaggctgctgcttcttcgaagcgcttgcggatgtcgaggtcttgttcgtattcttggaagatgtcgacgtctgttgggaagaagaacgcgcggagagttgagactgtgaactcgaagaggaggactgctgagacagagaggaagaggacggtccagaagaggaggttgtggccggagtgatggatgaagttggaggggaggaagtagatgcctttgccggaggacattgtgtattcgcggtcgaggatcagatcccacatgaaccagccgccaacggagattatcactacgattagcgacaggtaggttttgttgtggacttccaggacttggagcttcatgttgatgacgatgatgcacgcagagtaggttagtaaacccagggagaagatgtcgttgtcgctggggttcactcttgccaggccatagagactccacatggtgaagaaaattatcaccgctccgcaggtccccatgaatgaccagcccaagtagagccggatattgaagccgccatgcctttgacccttggtgtagagctcaggcacggccaacagtgtcgatgcggagaggtctttggtgaagatacccaggaagatgacagcgagtgaggtgaacagagtgttgaacatactcagactccacggctcgtacaaactggttccagtgtagccgttccagcgctgatacagcgcttgagtcagatagaacagcatttccttccagaacgtgccgagggtatacttgcaggcacgcaggtagttccaccgtccgtgcaccagaagtagcttgagtaggaagcggaactgcgcaatcgagtaatccgaaatacgtgctgcctgcaacccctcctttccagtgattccaatacccacatgggcctcctggatcatggcgatatcgttggcgccatctccaatcgcaagcgtgattgcgtcggtgagctgtttgcggattgacctcaccaagaacgctttttgcttcgggctcgcgcggcaacagataaccgagtctaccttgacagccagctggaagaactgttcacggaccacctcattcgcttcgatcaacgacagcgtctggccatctaccacgaccactgaatgtgccacacggccacgggtaatctccccgataagatgcgcgatcgattgctcaacatcgccattctcatgatccagaatagtcaatgtcgagtactccttgacaaggcgacacgagtggccaacattgatagcagtctcccgcttatcaccagtcaacatccacatcttgatattggctcgtcgcaatttgtcaatagcctccggcacccctttttgcagcttatcctcaatagcagtggcaccagtaagctccagctgctgctcaatctgctcgccggcgtcctcaattttctgctgtcggtcaacgatgctagtgcatgcctcgttgtaggcagtcttccagttcgtgtaggtcgcttcatccaaaaaccggtgaccatacaacaaagtccgcaggccgtcagtggcaaagtcattcagatgctggaagcagcgctcgaaaatagccgcctcgttgacaactagtgcctcctccacaagatcctcatcgtcttcgccattcgtggagcttccagagtccgagatcgcagctgaggctctacccatctgcgccgaaggccgagggctgtaatactcactatcagcctctctgtatcgcataccaccatccgtttccctgtcgcgcagccaaacatcgatactagctcgaagagccgagccctgttggccagtgattgacgaacgccgacggttgaagctcggccgggtcatactgctccgagcaccactgttcttccggctgtggtgctcgctgttacgtcggatgacttggttcatctctgcattcttgcgtctgcttgcacgacgctcgatctcggtcgctttctcatgcgccaggtcggcttgcttcaggagacgcatcagtgtggtgtcggcacctttgcagaataggcaaatgcgctggtcgggcatgcgcacgacaaccgacatgcgctttcgcgcacttgagaattcgatcacgtccaggacctcgtagacttcgtcactggtggcttcgtgcggtccgtttggttgtgtgcggatagtcaatgtgtttgattggcgatccacgacgagatatccgagttcctgcgctgcaagaacaagagctaactcatcgggggaggaagcctggaaagtggtgtttccgttcgcgtcttcttcgggaatgcatgtgtgacacagagccatagacaaaatgaataatttcgcctttcgggcaaagatggtgtaaggcttgcgctggatatattcgagcatctcctcggtgcggtatgtagtagccgaccggccagactggcggagagcatcaagaggcccagaaacattcgacggacggggcatctgagcctcggaaacattagacttgcggcccatagcctttttcccctttgtactccgcttcttgtggatcaacttggtgtggtcgcctgcgagagcagcttcttcctgaaggtcggcgtcatgcaaccacgcggttccagccacactcatcttgcggaatcgcatggagttatttgtcagggtaccggtcttgtcggagaagatgtagctgacttgaccgagctcctcgttgatggtggatgtgcgcgcctcgagcggggtgtcggtttcgggatcgtacatatcgatatcattgagaagcagcatctgggcaactttgacgatttccatactcacgtacagggagatgggaatcatggtgttgaacatgatcaggaatgaagtgaagattggcccataggaaacactagcatcttcaaggtaccaggaatgttgctccacgtcctgagaccagtacttgtaggacacggtgcagataacggccagaataacgaccaacaccacaatcaacatgaccacgcgattgaccttgtcttggagagcgggccttttaattcgcgggttcttgttggcgttcatgcggatcttgcactcctcgccagtataaattaccatacccagagcgcggtcggtgttgcgaaggatgctgccacggtaaacgatctcgttgttagtcaagggcagtttctcctggccattgacgctgacgtgaccgtcgaacttatagagatccaagttggggtcctcaacgacgaagtgcaaggagttgctattgatgtcctccacagtcgagcacaccttggatacaggttgacaaggctgcttgtttttcaaatttgtctcaccgtcgagagccatagtctcaatgtaagcgacaccgttgggtccgctggcgtggaggagagcaatatcagcgggaatcggctggtcgcgctcaagtttgataacgtcgccgacgcgaatgtcctcacacttgattcgctcccaatcttgagcgttgcttatcatggaggcgccgtcctggatcgttccgtggccttggcggagcacccaagcatcccgattgttctcttccttgtccaaacgataccggcgccagtcatcaaatccttccttgcccattgagataccaacgaagattaaaagcggaacgatggttgtgtatgttccagttgtactcaggccagggatcatctgcaggatggctacaactaagaagtagaagttggcgactttggtgaactgggcgaagaattggcggggaaagaaactccagagactgtaacgactcgaacgaatgtagttaccgatataaggcttctgggtgcgctcatcgatcatggaacccaccatagacggatttaagtcaatgtggcgcccatccttagtaggtgggatatccttgatgcgcagaataaatttctggatagaggtcataacagcctggaaacgcgcgacagccactgcagtagtcgcctttttctggagccacttctcatgagccacagacacggagaactgttccttgagacccttttccgaaggttcggaggagacataaggggaagcatcctccttatgcgtcgagtcgagcgtggccgtcggcgcgacgcttaaagcatgcttctcatcggtggcagtgagtgtctcagcagtcggggcctgggccggagtcacattagacgaaggttccttgacctcacccagctcagccagggcgaggtcatccttctccgtcgagttgatggtcttattaaatatggtgcgacggagcgagtacccacggtttcgcgaccgagaccgaccggcggactcaggactcggcgggggaatcggggagagggtcgcatttcggggcgagagtggtgaggtgggtgagggagcggctcgaacagatggaggcgccagcgccgtgttgatggttaggccgcgagaattggggcgtccatcccagtttgtctgtcgttgttcctcggccgactcgcgatcgagatcggttgagaagcgcacatgttgggaggagatccgccgcccggaatcggagagggttcgtgagggtacaagagatgggcgtcggagggcatcgttctgttcgggttggctgccctctgtaggctctgtagatctgtcgttggacatggcgacagtcgaattcctggcacgaatgcgcgggacagatcccgacgatctcggtatcttttttttttctcccctccgaaattattggatccttcctctgctagtatccccctcaagatcaaagtaaagtattcgattgagcgcaccgattagacagtcatccttgtgctgttctttcagtggagatgttttcccctaaatgaaggtgttgcgagggttgagcaaacgaaagtactcccgtcggacgcaaggatagaaaggaagggcgcagtgatttcgtactgttgtatagaagagaaaaagaacagaggccaagaagactaagagactaagagactaagactaaaaaaaacccagagagagaggagcagccaagacccagtcttgagggaagtggtaaacccaaaacggcctagtgttccaactgacgatatctacgaagagtacgagtactccatacaaggatatgataggcatagaatgagaaaattggagttaaagtgggcattggaaacccccgtctaaaacgtctaagaccttcccaatcgccaaaaccgttccaaccttggaagttctgggcaacgcgtaagatgcaaccatcgaatgcccacgctgacgcccccggcacagccccagccaggtttaaattaagaatcgtccaatcagatgggattgtccctcgctgcattggggcgaaaggcccgctggatccagatctaccagagttttaattggccaccctcacattcccaggaccctgcagccctattgcagatggaaaattggggggaacgacaggcctaagtaggtacatggtaggtacggagtacatggtaggtatatggtgacttctaaggttcttctctcttttcctcttttagccaatacatgtataatatgctgcatatgtacaaccactcttgagcgccctagcgaactcgtgggctgattcgttttagtgtagccttggcaggccccttcacaaaggaccgactacatatgtaccttaggtaccccgtacgccatagacctgtcaaccttggaaggccccaaatctaaaagatagaaaaataatattcaacttaaagttaggttcgagttcgtaattcatggaaactacgtggagtaaaagaacccaactaccttccctcaaacgcatggcgaaaaaaccgtaaactcagaagccctatgatgtcacattccatcaatagcgtggcggctgtccaccatactggtagccaggtccaggggatccatacccatgtggctgctgttggccatacccaccccgcgatccctggtagggaggctgctggggaggctgttggtattggccctgcggtgggtagcctggctgagaaccgtacgaagccggtggggcaccagggggcggaccatacggaggctgagcttggccctggggtggcggaggttggccgtaccctcctccgtactggcctgttggtgggggtgcaccacgacgttgattctctcgctcatccttggtgtcgtaagaagaatcgatagcgccgagcatcagtttggcgcactaaacggacagccagttaaaaactaatgcaatcatcaaatatgttgaaacgacttacccaaagctcgcgagtgagatgcacgggtgggttagcacgcgacatctcatcctgctcaacctcaaagtctagaacaccacgttagttagatccactatagaaccccacgtgaaacttactggaagtacagtcgatcagatggccgatatgagggtcctcatccagagagcccaagaagtcgcgagcccgctgatcagttcccacctgcgagaactggaaggctacggtgccggggccataacgggtccgtgacgtctcctccactgcgtagcgaatgacatcacccacggtaccatgaggctcgccagcaggctgtccgtcggtgatggtgatcaccagaacgggcttgtcgagacggttggcctgggcgggttgaacaaccatggggtcgatgactttgctcctcagactggtgcccagaggggtcaggcctgaaaaacggactcgggacactaggcgctcgacatcctctgcattgcggatgccatcgcccttctcgctggagttcatgaatcggacagaaataccatcctggtcaaaggtagatgcggcagtagctacgatgccgagaatttgtttgagctggtcctttcggagtcccttctcttcgaattcgatagatccactgtcatcaacatagagaaccacgtcaaacagcgaaagcttcatgacatcggtcgcaacctccataggcacggcccattcatgaatcagcctattgagcttgcctggtgcttcagcggcaagcgactgaacgagtcggtccagtcgctcgggagggtagaagctttggaggttcttctcctgaatcgcggaaatcaaaagcgatcggtaggctgcgacctgttgctgagtggccgggggagatgcggagggaggggcgccaccgggtgcgccatattggcctggcggcggtccgcttggtggtcctggtgagggaccaggacggccctggccaccggggtacggggaaccctgggtagggtagggtggtgcctggttcaattttccgttagcatcactttccaactattacccattcaacgacaatccgaatactcagacaggatacacagaaataggcagtgatgcagggcagggggtattttgtacatatggcggctgctgtccggggtatggttgttgtccaggatattgctgctgtccggggtattgctgctgtccgggatattgctgctgtccgggatattgttgttgtccggggtatccttgtggaggagcttgctgttgaccaggatagggcgaactaggagaagcatagggctgtcccggttgctgacctgggtatggcgagctagcggagggataaggctggccttgtggtgggggtggaggcgggcggccatagccctgagattgctgagattgctgcgattgctgcgaggcggggtatggtgtggatggcgggggcctggagtacggagatgatggattgttctgaggttgagatgagccgccgtatggaggatagccttggtaaggtcccgacatggttccagaaatatgatgaccgtggaggggtaaatcgtggaagcgggggaaaatcacggaaagcaaaaagacttaagaaaaaatatagcttaccgatccctggggggctggggatcctgaataagcctggtattggggctgttggctctgctaaacattagcacttttttctttttccttctgtatgacgtcgaacgagtcatagcagaagcaggcgcagagatggacatgacttaccgatccaccaggctgcagagcggcaggaggacccccagtgtatcctgacggaggtgcacctccatatgaaccactgttagccatgttctggctattctgagctgcggcgattttctgagcaaactaaagatagtcagattgaggggttctctaggagttgtagtgggagaaatctggaagacttacacccatgatagaactggatggggaaaagaggagaaaaagtaagacacagagaagtatcacgagaggaatccaaagttcgatgacgttgcctgatgtggatagcccctcttagtcgcctaagtgaggctgagctgtatacggagtacggagtacgaaaggtacctcgggatacttggcgcccccacttctccttcccagcaaagaaggtacctccaagtatcttaaatgaagtcagcaggttgatataaatgcggccctatacatataataacacatatgacaacgaattcttggccagagtcatttccacggtgccggtttatgagggcgcttggcctccccactacttatttttacacctccgagcctgaacaggatgcttactgagtaaacaatatgccgacctgtgcatgggtgaacctgtggacctgggaaaaaaacacgtgcttctctttatagctgaaaccgaacatgtcaataggcatccaagctggaatttaaccaatacaccctagctccctcaggtttcacggagcaaatgcgcgatgatcatatccagatagaccccagcacggggtgtggtggcctcaacaccctccaatttggcagcatcatcccacagtcgaagtgagaccatttcgtctcgaagtggatcttcctcaaagttcctgaggtctgcatctcggaagggccccccttgaaatgccagcgacttctgcgaggcagatgatagagatccgtggtatctctggtccgtagcagtgaggtacctaaaagatgagcctgggctcgcaaaaagacggacaagatcacctaccgcttcgcagcgacatgactatttaccaagcgacacactacttcgctgaatccaagggatcgcaggtatgatgccccgatggcttcatggccgacacggccgacgttttccgtgctttcgcgaagattcatgcgtgcctcctcggtggattctagcggaatgatttgaccaatatcatgcaataaagccgcaattaccaactcgtcacgagcatctcgaagatatcagtgaccgtcagagatattaggattaatacgcactcgctttactggcctggtgagccgcctgcagacagtgttctaactggctaatcgactccccgatgtagtcgccttggccatacttttctagagcgccgatcaaagcctctgctttttcttcgggtgattgctgattcatagtcctatttaatcggataggaggggcgttgtgagaaacaagatccggctggacaaaggagagatgaggaagaagcgaggtggaaccttggaaggaagtgtttatatacgccatggcccttttactctatcttcggtccagttgcaagtaccttgactaaagtgttcggtcatcatgccggtggcccacacccgtcagatttgaagtctggacctgactagtatatttcagtaagacatacattttacctagttagaggtattctgttttgactaatcgatgaagttgttacaacatctttggatcacttttgctttacaaagtatgccatgcggcttgactatacccatcaggccgacatcacctttgagtccacagtcaacataggggacccaaaggcatatcgcacacgaccttcctcgtatgactgtccgctttgccgcatgtgtgtcgcaggccagagtttctgacggtcggaatagtactggtcgtgtagattaccttcagcggcacagttatacgttgcatagatcgcacgccggtccttagagctagcattggcgccactgcgatgggccagatacgagccaaaaatcaagatatctcctactttcattaacgaaactgcgatgaaagtattggtgagcttttcaatctgcatacctgactcgagctcagctggtgtccagacattgctttcgacccaatcggacgcaatgcagcgatcactgccgagaggaatatccatgcggtggctgccgtccaccacttccagacctccattggtagcattcattccatcgaccgccgcaaggattgtcaaatgcttgatgtttttaacatgggtgtaggcattggcatcgatatgaggatcaaaaccgcctatcaaacaggtgagttatcaaaacaggcctgtaaagcgggaactgcttaccacttcctgccaacttgtagttaatcttctctttgaagagaagcatctcctctcctgcgagttgttgtagaacacttgttgcacgctgtcctcggaggaagctatcgaatccggcatgcgagttggcaaagttttcagtgcgacacagcacgtgtttgccttccgaatttacctcctcataaggcatccagggcacgtcaggggtgcatggaagatcgtggacttcctgcgcccattctcgcaacagctccgattccttagaagtgaaaaacccacggatcagtaggtatccacgcttctggaagctctccagctgctcagtagagagcgagtaatgggaattgttcatttctgttaccggtatattcgagtaaaaacactgaagacgccgtgctggtgaaacattgcgggctcagaagctcgcattttgtagatcaatcgaaagtccggaggtatcgcccttcgcaccgagatgagtatttcttaaacgcgacaaaatatagatccgccatgtgagatgttcaagcacatgaaagaaagataagctccgataggcctgacaaacgggtactaccctatctgaggaggctgaggatctggagagactggatactcaggcacatggctgaaagatgagttctgatagggttgacgatcaggcagtcaaaggtcaccatgaaactaccgagactgtggagttctggtatccccggggatataaggcagggggagcttagactccaactgagtacagatccacccgcacatctcgcacttcccaccgacgttatcgtgcctctattccacgccgtcattggtctcttttaggaagtaatacactagccataaaatatacctagatagtttctatagatataaatatgtccccgttgatattggtaacatatagcaatttgtatttcattcagtatcctggtcaacatggctacatctcgcaatgactctctcatgaagatggaagattccaaggagcaaatctcgcaaaccgactgggatactgagcaacggaaacccgagaagaagcgctcgggtgtgctcaatgtagtggtatccgggttggccttgttcagtgatggatacaacgctcaaatcagtacgtgttgacctatatctccaaaggtcttctttttactccctgtactaaccgcatggtagttggttacatggagcctttattctcagtcctgtgagtagccctatttccggaacaattttggctaaattgactgatgagtccagttacatggatggaatgtcctcaactataaagtcccgcctttcaaattcttatctcatcggcgagatattcggcatgcttttctttggtgttctaattgaccgtattggtcgtcggactggtatcattgccgcaacggcgtttcttattcttggagtggtgctggcaactgcctctcatgggaaatcgcaactagggtatcttgtccaatacacttcagccattttgatcgagacacattactaacaccacattaagaatgttttggatgatgattgttgcacgaggcattgcaggatttggtgccggaggagaatatcctgtttgtgccactagtgccactgaagctgccgatgagacaatcgacctccgaaagcgacgtggcttcttggttgcactcaccaccgattttgccatagatcttgtcagtaccagtacgacgtcgatggcctccttgctaactttacgttagggatttgttgcagctggcttgatcgctcttattgttctcgcgtgttacagccaacaagattctgaaggagtctggcgcgttacgttcggtctgggtattgtggtaggtctcttgtctgataaagagctagtaagatgtaatgattctgacattggtatcagctaccaatatcaatttgtttcttccgcgtccggatggtcaactctactcaataccaaaagcacgctatcaagtcgcagtatccctatggattagtactacgtcgctactggaagcccatgcttggaacatgtgagtccgttcagcttggttaaattgtacggtggccttagctaacgttgatatttgtagccatggcttggttctgctacgacttcgtcacatatccatttggtctcttctcatccaccatcattgagcagctgaatcccaacaacaccacattccagaatattggatacggggtaggtcatcatatcaccatgttctagcttcgtagactgacaacataatttccagactgttatcaactgtttctaccttccaggatgtttgattggtggtatcctaatggaccgaatcggccgtaaacagaacatgaccctaggtttcatgctctggggtatatggggatttatcctgggagctgccctccatccgattcagagtgttttcccgcttttcatagtcatgtacggcatttttcaagcactcggggagatgggccctggagtgtcgacgtttctctgtgcttcggagtcgttcccaacacccctgcgcggtcatttcctcggatttgcagctgcagttggcaaagctggggcatctattgggacagaagtcttcaccccaattcagaactccttcgatactaccgctaaaggccagcaagcggttttcctaattggtgcggcctttacaatggtgggtggtattctttcctggttcctcatcccagatatgtctcgagagctagagacagaggattccaagtttaaagcatacctggaagagaatggctatgacataagttcgtatggcgaagcattggttgtcaatgcccgcgcttcaacttaaccaccctggtagacaaaaaggaatacagagagagttgagaaatacaccagattcagggcaatattataatacctaaatgagaataacaagttgtgtggtaacaaaaccatagtacgatcttgctataggctgtgttaactcaagggagggatctagtaggccaggcccgaacatgtcggcatctaatcatgagtctcagatcaaaggagataattccatactattttagacctttttgtcgcaattcagatcaagcatactattgtactaatacttcacctgctacttcgcttgaagtagttctggttgtttactgcgacccacatctccacttttatagaacggaggataattcttatttttgttcttacatctatagataggatacttttacaaaagtccatcaacacggcatacagcaaagcattttgattaaagctctgtctaagcagatgagtctacgccagaagcatgacccttcgtcactacacgcgatgatgcctttcattcccaaccaatgtcggttgtacacgtcgcctgaaccatatttaacaagataggatcggcagaagatctgcgactgtctccctaaatatatgaagtgcatcagaatcaaatcttactgaccatggataaaatccggggtaaaactctgaccgaagtatgaaatgtgatcactggacgatgatgtcacaaagttggcatgcttcagggatgcccttgaaaacgacgctgcacagctcacagctcacagggctcttttctttgtttgatcatcctaaagatcgcatcatgaagcatcactcgtactctatctaatcttttgcgctttgctcactttcacattctcaactcccttaatccctaaagagctacctggaatatcattcatattctcagtcattcagctcaggcgacctacaaaaggcccggtcatctctcggctttcttccacctgtaaccatctgatctacagcccccgacctttcctctaacatgtcaacccctgtcctccgcctaggcatcctaggcgccacgaacgccgtccaagcaacctatcttccggtcctccgttccttgaaaacgcattacaccctcacagccatctacgaccccaacgccgagatcgcaaaccaatgccaatcccgcttcgacataacctacagcaccacagtcgtcgaagatgtcctgcgccataaagaagtggacgtcatcctcaacctcctcccaatggagtaccacgagcaatacaccgcgacagccctcgaagcgggcaaagacgtcatggtcgaagtgcctctcacaatgagtatctcaagcctacgccggatccgggaagcagtcaagaaaggcaaagtctcccgatccctggacggcaccaacgaaacagacgggcccaaggtattcgtcggatgtgcgcgccgctacgccccctgcttcacagaagtctttaaaaaggaactcgcggccctaggccgcgtatactacgcgcgctgccgacacatcgcgggcccaatgaaccacatcggcacaccaacctcgagagacatcgcgccgtcaatgaagaggaacaataacccggagcagttccgcgcactgctgaatgacgtcttcgggtcggaagaggatctcacacctgacagagtcgctttctgtcgctacctcggcatgctggggtgtcatgatctatcagtgatgcgcgagtcgttgggattcccagatgccgtttctaacgtcgctatcacggacccgttctactcggccattttccactacacgaattccgctgagaatgacggtcacccgttcatacttgtctatgaggctggggttgatgccataccccgctgcgatgctcatttgactgtctacggcgcgcacaagactctcagcgtggagtatgacttcccgcgtcctggggagaagatcagtactgggacttatgtgcgggttgttgttgaggaagcggatgggacgacggagtcggataatgtcaatggaaatcagatcaacgtggtggagaatgctgttcctctgcctcgtgtgaggcgtacggagactgtcagtacctgtgacgaggcgtatgagcgtgaattcatggctctgcattcttatctggttggtggcgcgtcggcggcgaagacaactgctgacgacgctgtcatggatctgcggctgctgcttatgatctttgaccattacaaccgccaatgcggcaccattcggactccgttgggttgagcgtcgattcctgacaggtggtttgaaagcggtggaggggacattcgtcgggtattttctcaaagaagtcgctagtacttgagctggttttacgggggctgtttacatctggttattggggggaggggcgcggatcggagcctccggagctgaaaaggctggtgggaatatattttactcgcagtctggggttttaggtgccctttaatatgaaatacgggatacatacctggttccatgtatcgtaggtagcattcaggctatgatatctatctgtctgatattacactatcgcttgcccttcttcttattcttcttagcattagagccaccgccggacttttgctgctgaacgggagactcttcagccttctcgttcacaggaccgccctgcgtgagtgcagcagcacgctgcttacccttcttgcccttgggtctgtaagaagagcggtcgcgcacaggcagccagcgctcagggtcgggcttcttggcgggatcgaagtccttgggcagacgggacttgcggacacgcttgttggcgcggtcattggcgctagctgcggtgcgcttgcgggcaccagcgaaggcagcagcagccgctgcaaccgaggaggcggagggagagatgccagcggattccagggctgagacgtcgacgtcggcaatcaggtcaccgaccgccggcaggcggtcgagttcggactcaatctgcgcatagtccagagttgcttgtgaggcaacatagccagcgatggcagtgcgatcgttggggtcttgctggtgcagaccacggaatagatcacctgccgtggctaggtcggagcggtcttcagagtgcaggagggaagcggctgctgcgcggaggagggacacggggggctcgggcttcgcgcgccagtaggaggcggcttgtgcgagggtggtgcggatctgaaccatgcgaccttcgcgctggtacagggagacgaggatgctgaggaggcctgggttgaagcggatggactcgtttgacccttcaagactgcggagggtttgctccatggctgtgatagcagaggtggtgttgccgccgctgacatagagctgtaccactgtcagaagaaggccgatgtccgtgggccgtcgctctagcaagggaacgatctgtttgagggctttagggccggtttcgccttgagcgcgtgctgcggcgttgaatacagagagaaggttggtgatggcgtcggtagatgggcttgggcgttttgactgtgccttagctgtggaccggattataccatcgtacttttgcacaaggaggtctgcggcgtgggagttgccaaccatatcacggtcctgaaattcgaatagtcgatcattattgatggcatctggggtgtcgtggagggccttgtagaggatgtaggggttgacgtcagtcggacgagcgaggacaatgttgttgcgggcaatctttttggtagataactcggtgatgctaggaaaggatgtaagtaacgagtttcgaactggcatgattcaacatacttttccacggagatatctttgagaacagcctcggcctcttccaactttccaagttgaatcaagacatagagttgttgaactgcgattggcagcagctctgcggccttgtcttcaggtgaaaggtcctctgatgtgcggcagatatctatgcagaatgtcagtatgggtcctagtcttgggcaacaaggtggcatgctgactttgagctcgattgagcaagacctcgctctgcttgaattctccctttgcaatgttcaagcaagctgcgttgtaggttgtttcaaatgattccaaatcctccctcgacaatcgatcgtggcgcacgaattccgtctcccctttccattgaagctgggcatcggtagcccacgaattgatgttcaggtcattaacctcgtgagcggaagacgtcgcatctttggagagttgttcataaagctcagctgcccgtcggaagttctcggcacgatagcgctgttacgacaagacaatcaacattggtcctcaagcagaaggacagatggggcaccataccacttgtgcctcgaggtgactagcaccacgcccggcagctgtgcgagtcaaggcttctgtggcttcttcaagcttcccgcatttatatgatgcatacgcgtattccaggcctgcactctgtttcagcgcatcgcctccggcctggaatgtcttgagagcttcttcgtaacggtcgagtttcaacagagcgacgactttcatgtgctgcgcttgcaaatcggatttggatttggcgagggctgcattgcatgactggaggacttcctcgtggtcgtcaatcgacgcccgctgcaatagcgaggccagcgattgcgcaaccatggcgggggtcgctcgagaatttcggggtggtaatagggggcgaagaagatggtaacttcagtatccgatgaaagatgaaattgtgggatttatacaaagaacacagtggccgatttccccagatcaactgatatcaaactccaatgtgcggaactggtcttttccccattggggggtttctgcgcttaacgctaatatgccccgccgtagctcacgtgtcatatttgagcatcagcaagttcacgaataacggtgacagatctcgaattgctcggctttgtagagcgtgtcctgagctgaaactgcgtcaaagtcaattcttgcattgcaaactcgatatacacaaaatttttagcggttatcctggtacttcaaattcacgagtgctgagaccgggggggggggggggtctggaactgggttcaccgtgggatcacatcctctatcggttaacgtacatatttacaacgcaagatacggaggatttatatcggagatggctagactacaccaacgaccctaatccatataccgatggcggctatgtgagtctatggccgctgattgagtcttattcatgttctaacctattggcatacatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggggggggctccgcagctggactacccgaaacatactgaggaaacgaacgttgccgccaacgcgctttctttcgtggtgatatgtacctagcgtgttgaacgatggatagccagccctgcagacctggagacgcaatcaccttagttaagatacgaaggagaaaggaagttttcttcatgtcgatccatcatcatgtccaaggatgattcccactggcccctccctcgtcatttcacatgttgtctagtatctcattgagctgctcgcgcgttctggtaacctttgaaaaaatatgtagttaactagcgtatattcttgcctagccaccaaggcaacctgacatcaatgccatgttttccctgcatccacttatagagtgctcgtgccctgtacttcttaccagtacggagtgccttatacttcatacatcaacagcctcagcactaagttccggcatattacctgttataaatgacgctggccaatagtggagatgtagcgttagattcctgcctaatttaggatgaaattctacatcgggagttatgaaaccatcctcaactatgaagcgactctaaatcacagtgtagtcttctggacggtgtttggattgacaagtactcccaacaatgtcggacatatctctctgtcccattttctggatcggcacatccagtgggtctccgaggtgcttaaagcgaattaaagtggggcaaaactctgtcccgctaagtccattaaaatatcgtcaataggagctcgaagtgataagatgatcaagtgccacttgcctatgagcagactaggattggaactctacgtgatgttcggtatgttgcccactgagtctattctatatatcgtgtgttgatatctatcctttatattctttgttaactcgtgatccatagaggagaaatcatatcgtggcagatcgaactgatgaggaccccccgtcgattcctgccagctatgacccacgctcagaatacagctctgactagtgccggaaagagttatagggagctttcattcatgtgagggccctcgaggaaagactccgagccggccccgaagtgcccagaacatccatggatggtctctgtttattcagatatccgaaaaggtgaccttcagctacccggaacctaggacataagcctttccccatcgggtcgcatttggcaatcggtttcaacggatatgcctattccgatcgcttttgtcgactggttcctccgcctctagagctaattggaacgatactaactgttgattattcagtcactatgctttgagaaagaacatcgaaggagcttggatgaatcatgaatccaggtaaacctgataaaatcaatggtggccctaatagcttctggaactgggttcaccgtgggatcacatcctctatcggttaacgtacatatttacaacgcaagatacggaggatttatatcggagatggctagactacacaaacgaccctaatccatataccgatggcggctatgtgagtctatggccgctgattgagtcttattcatgttctaacctattgtcatacatttagcgcaagacggcacgggtcgaaatttgtttgaaaccggcaacttggtaagttcacgagaaaaggaggtcattcaaactgacagccatctctttcctagctggaggacttgtatgagccactctgctttccactttattacttcataccatcaaaaacacagagagaaggaagggagaagccgtggtagttcctatttaccatttcttctccatgcatgcatatgttattcttgatgatcttttgttgtactttttatttgaatccatactacttgcgaaactaagtcttacttcacggaaaggaaagacttaggaatggcaacgtcgaaaggagccctggggattgtctgaccgactcgtaagcccttgccctagccaccagctacgcatcttaggggccacagttcggaggatgatgaaatccgcagaggaacaagaaatatccatacaaaccatgcgtaaggcagactaggcttccttatgcgagtggaactccagtaagccccattggcattggcatcgggggctgggtcggctcgactccgtacaccgtacagtacggagtacaacatacatgttggcaatgccccaaaagttctcgtgagaaaagagtaataggcttgaatatcacccaaagatcttcaatcaatacagtggggctgagtgatagcgtggtgggaacagtgcgtagatgaaccaagctgtccctggggagttgcaaatagccatgtcacaaatgtcaattgttatatacaacatacaacaatggctgtccggaaattactccgttatactccattgtagtgcgtatttagggcgaaatagtgtcttggctatctaggctatctaggccattttggacggagtagcacacgggtagaggacgcgcggatgtggggaatggagggatcacagacgagtgagaggcagggatcactgcttcggaagtcttggcactggcacggttgtactccagctctctgtacactggattgggagtacaacgttgtaggaatcaccatgctaaattggtattggaagggatagattgccacggaggcatgttggccctatatagcttcgtacctggatataatttccaaccccttgaagttacagtgggaccagacccctacaggtatatgtgaatgcacgtgactttcgccaaatggaccctgcaacgtcatcgatcgtctttcaggccccttagagaattggccctgtccattttcatcccatggaaccatgatcgcccatttgacccttatcttcccgttcttttcattttcttcctcttcctcttcctcttcctctcctccatccctctccataccacctgggcatatttataccgcactttcatccgcctgcgaccgtgggcccttgattgtgttctagaccaaattcttatctccgcaatgcggtagaagccgacaaaatctcacaacacaaaaaatgctattcagtgcccgagatgggtctgttcctggggcgtcatgggcctggaaaaaggtgctgcggtttggagctgtcttcctgtttgtggtaggatttgccgctgtactatggccctcggtcgagccagtgaagctgcctctgcagacagtttccaacaacattaccgtcggccccgatgtcttatgcgatctcgactacgacaaattggaaagcctagacgttgtcaatgtcgcccaatacacccgccgagaaatcgtactcgatatgacggacgaaccagtgccctacacacagtggcttgagcaaccgttcttggaagtgccaaagggcactgagggagcagcggacgggtgctcaattcccgccccagtgtccttgcgggtcccacagccaccgaaattggcggacgcgtcacacatcgattttggcgtcgcgaccagtgtcgagagattgaatgagtctctggatgcattcgctcactgggctggatactcgcgctgtcgcattttcgcgctgattgaaccggatcactcggagaacggaaaacgggatgtcttgaccaaggccgactcgctggggatcaacctccacatcagtgaggtggaggatgactacctcaaccgatacttcgcactcatccctcttttgaaggagaatgcgcgggaaacaacccgatggggctgtattatcgacgacgacacattcttcctgtcaatgcccagactggtggatgcgctcgccaaatacgaccacaccacctctatgtatattggcggattgtcagagtctatcccgcaaattgcggcattcggaatgattggatttggaggtgcaggcgtcttcttatcgaaacctctcttggtggaaatgaccaacgtgtacgacaagtgttctgcgatggatttcacaggcgatcgtcgcatcgccatctgcgtgtaccgctacacccagacccggctgacggtggaccaccgtctaagacagttggacctgatgcacgacgcctctggattcttcgagtccggccgcgagccaccgctcacagtgcaccactggaagtcctggttccacgccgacatgccgaagctagcggtggtcgccgagctatgcggcgacagctgcctcctccgcaaatggcactttggggacggttggatcttgacgaacgggttctcggtcatcaagtatcacgccgacccagaccaggacgacttcgccatggagcagacctgggacgcccacaatggcgccaatgacgaatcttacctgcacgaattgggtcccctccgccgcaaggacgagcataaaaggtcattccaactgcaggatgccgttcacgaggagaacgaccgtgtcactcagtggtatgtcatgcgcgatgagaaaaacggtgatcaaatcttggagctgtcatggcgcaagagataaatagttttgttttgccttgtgcatgtacagtacgtgtacgggctcctttatatggtcttctggccccggcggtctgctggatcaataagcccaacttcaggcgcatgggcgcatgggcaaaggaatgccactttgcatggagtttcgtttcgttgtttatagatgatagacaccttttttggctaccctaatgagttgaataatgtgatatggatgtttggattacctcttctggtgcaagattgtagcccttgaagatatacctgaggaacggccctctctcgagtactccgtacctaggctgcttaatcttggcgtggctcgactccaagtttggctgttctagcaccgacgcaggcagttcttagttcgggtattggggtaacagcttcatcattcaaggcctcgatcggctcattcgagccttttcgatgtatgactaaatgcacgtgtctaccaggtatgactttacacatctatagaggtcagtgacgatagatggtagataaagcaaagagcaagtggaaggacccgcctgtctaccatggtaagcaaggctgtcaaagcccctggaggccatagctcaccgatagaaattatgccgtaccatggaaccaatgaatatgccagtcccttgcatatacctagccacacagctatagtcttttgtgactggcgtacagataggtgtcaaacatgtggtttgtagttctatatagaccgagcgttttatttctttccttctctgcggatatatccgaaatatatatttacaagaaccagcttttcaacctctattattgtaaacctactttaacaccataactacaatgttagactgaaccagctagttatacaacaagccatagatatattatatatgcgagccgagagtcacgagaacaagaaacaaaccccctttcgtagatgtacacctcaattcgcgaacacacggggtatcatttgaccaccgtctatcggagacaataacggcttgtagtaacatttagtacggaatacggcataggggaatgccgtgacccagcgaagatcctatggaacccctgaagatcgatcggcgttgactgtcgatcgagatactcggtacggagtacggagtccatactccaatgtaacggatgtgagaccaagtggagtaatcagtaagcagtgagcagtaattactaattacccagtactacttggtatccatagacagtacggagtacctaagcagttaagaccaaggtatacgatccggagctatttgatattccacttattaccagtgacaacctgcatcaagttccatcgtcccatcgaagagagccagatgcgcaattttgagtcatcggaaggcagtcaagactagaataagagatgggaagttaaagacgtgctgtttcagtctgcatcgcccgtatccatcgatgagatattttcctcataccgggtcccctcccggtggaacatggatcatagtgcaacgcaatgcttcagggtcgtctgcatgcttctacgccacgtgtttggtacggagtatattttggtgccagggatagcatattttctgcaattggtctcgcgcagcaggctgagacgagctagtgttgaattatctgtgactatttaccttggtgtgatgagttaggcacatcagtgggccagtgctcaatttccccaggagaaagggtgacatcagagtggaatctgcgacagagacagaaaatcgggccatttggtcatagcgtacgcggctgttcctggattttgcggatatttgttttctctttttcttggtacggagtacatatatacatatgtacatatctggttatgtccacgggtactccggaggttgcccaaaatgtgtgtctgatcttccaatacatacaacatagagttacctagcctccgggagggaaaattcctcctaatttgtcagaaaccaaccttgcagtcataaaacatacccaaaactgacctgtacaggacatgctccatcccaggggctacggaggtacaggctgaaaatgttctactaatagaaatatggagactagcgtgtctcagccacaaccatgtgccagccatccaatatgcgtcggcctgacccgccctagttcgattttccgttggcgattgcgcaaaatcaaggaaactactccgtacaatatagtcaatggcgaactataatagatcgtcttgtcagccattggttgaccaagtcccctaagatgccagcattttgtttattcggctttacacggatggtatttacaaaacattgtagaggggagataatctccgcaactccccgcaggcaggacccgggttgacaccaaaccccggcaagtgcagatgatgggtgtcgtcattttcgtcacagttgccagggtatgcgttagcttcgtgaggggctgagaacggtaggtgtgtgagaaagagcgtgagaggataatcgcgccaatgaagaggaatagccttgaacagtcacctaggcagaacatgactggaccagtcatcctgcccagatggtgcccaactccccccctttttctggagttttattttattttgcctctaggcagatacctgtcggggtctgtttactttcttttatttttatttcttttttcctacattaatccctcgaggtgaaaggtatagtgcatagtcagggaggatatcctggtaaggctccgaaccgtgcgcaagatgggggccgcgcatgtctttcttttttctttttttttcttctacggcttctacggatgttccaaaatccttctggcggccttctggaaggcaaggagaaggcttggcggagccatccgtgccgtcttttgtggcagtaaagtgggttcccagaggctgaagccagccggtgccttctagtgtcccccggaagggaaaaggggcgaataagatgggttgtgtaattaccgatgcagactggattagctccactgcatcggagtccaggtacctaagaaaagaagaggggaaacagagtgagaatagaaagtcgaagtgtagttcgtcctaccgacagtgtaacccatatatgttgtatgctgcgtgaggtacggacaggaaaggttaccatcgtgatagtggaaaccttctagaagggtataaatctcgattttgcgctaacaatagtcgggatagactatcgaggtacggtaatctccttccacttgtacaaaaataagtatatcactcaatgtgtcgcaccatgagaaacctgcatgtcatcgttgatcaccgaggcctccaattactttttttttttctgtctttttggctttcatttttctcattcttttcctttatatttttcctgattattattattattattattttaaatcgcgaaatccggcagatgggaaatgcacgtattttctttttagcttcaggggccgtatgttgtagtttaggcccctttttccatactgtgggtgactttattaacgccttcctactttgattctctattaatccaatcctaacttatccctaaatctggttaatgtctggggaataaacgtcactataatatccagagagaaatttcaggggaccactgttgtatatcgaaaataataaggaaattcttcggatcggcctttcgtatccattttcgcacgggggagaaggtggatccttctggtgcggccaggtttccttctagcgggcttcgctgggtccgactaggagaactagcctttctagaaagggagttgagtttaggaggatgggattatttggagtatacgggaatgggggtatgctaagatatagaagagcaatatagtatcaaaattgatacttgaaatgataataatactaataaatactaataaatacgagtaaataaacccgaaaacaagatcaaaaccaaaaaagacaaagaaacaaaagaagtaaataaaaaaataatatgtacaaaaagatgcaagagacagtggcacctaccacacctaaatcacctaaatcatgtaataatcatatttcctatttctctctctctcctctctctctctcctctctcctctctcctctctcctctcccccctttctcatcttctactttttaacccttcgctttcctttcttttcttctcgatttcttcgatctctttgttatacctttgcccaaccccacttgctccgaattcctattccgaacttctttatttcctcgactcttccctaccatattttaatcttgaagcttccttcaaaaaggtatattttcgctcttaccttcaccgcgatttgtcagtgatgacgcatctcgcctattcgctttggctgcccaaccctctctggcgctgttatcttgggtttcgcgaccacggacaatttccccatctgtgctggcctcgtctttttcgtttccctggaaactcaacgttgcaactggtctcccactgagaaccgcggtgcacaggcgagaagtctacgagcttacagcactgtggtggaaagaactcggaatcgcaatcattttgatcttcgttccatgctgaccatcgacaattttttttcgcatagggatcttgacagggatagtagacctatctccaccttcaccgacaaacaatcacgcgttccgcaattagccgaccacaacattattctttgaggcgagcttggattttcggcagaaagcccatcgttcgacacctcttacgcaaccttgcattccactgcagaaaagtggagaatttaccccgtcccattcttcgctgagggactgtccaagacagaacgtgtaatacaggttcacgcagggtgagtttctggtctaagattctcccggctgcgcattcgcggagtctttgtcaatcgagctcgatctactgtaccgaaaatcggttctgactatatcgtgacttgcagagcttgctacttgtgacccgaatctcccacccgacgacctccatccttcctatcgaccagtccttacgcgtaaaggactccgaaaccaataagctatcggacttcgtcggaatattggtcacggaaggtctgccgaaggacgccttcgaaagcagtccttgaccgcggtcacttggctacttgctgggtcgggtcatggacttcacgacaatcctgaacaggaaaaactccgctgcagccgccgcagcagccgaagcgcagttacaacaacagtactttcaacagagtgcacagttacacaccggagcttctcccaccatgaagagcgaatcaggtggctcggacaaccctgtcaatgcataccctcctcatggtcctccgcccatgcagatggatgctggacttgcggattccttctattatgcacagcccacgggttcaacccctcgaaacatggcctatgcccctgcgggatacgctggcgatccccagatgcagcaggaacctgtcccgcagggaagagcaggggttgaaccaccgccaaagactttccactgctcaacctgcaacaagggcttcgcacggcgcagtgaccttgctcgacatggtatgtaccctaccagatattttggatatttccgagaggcagccactgacaacgtcttagagcgtattcacaccggagttagaccccatgcatgcgagtggccggggtgtggaaagcagttcattcaacgctcggctttaacagtgcactcccgtgtacacactggagagaagcctcatatgtgtgagagatgtggcaaggtgtgtatctttcctctctttttttggttctggctagatctaacagctattcagccctttagcgactcgtcctcgctggccagacatcgtcgcattcactccggcaagcgaccctacaaatgcccgtacgccaactgtcagaagaccttcacgcgccgtacgacgttgacacgccaccaaaaccaccacactgggaccatcgaagaagccgctgctgaaaccgaggcccaattgcggcaaaataaggatcgtggacgtcctggtgaaggaatgttctccgagcacgcttccatccactctacaccgtcacccgcgcagcatccatccatgtcacctggtggcgagcttcccccgctgaatatgcatcgctcagctggcgactactacatgggcaccggtcctatcccgcctcatgtgcgtggggatttcccccaaggcagccctcgggcttccccgactgcgacctctccttcgctgtccagctatggcagtgcgccccacacccggccatccatgacctcgcatccctacgctccgcctcagcctcttgaacccccggccaacagtgatcaccgtcccaatagtgtgaacggcagtccacacatgactagtctcggatgggcctcgccgtctcacggtagcatgccgtcgcccggatcggccaacgacttcacttaccccgagcccactggccctgcgtacccgacatcgatgccgccacacatgtacttccccaattctactattcgtcggcctaccagcaccgagccggagaactacgaaatgaagcctcgaggtgaccactcatggtccactgctgtatgatgcgattcacaatccacgccagtggtctcgcaacagcttgaattttccattatttcctttgttgaataaactcattgcataagccccttgattcccacgagagactacgtctgcgcctctcgattgatttttcttttatttcctttgtttttcttcatgcatttccttatccgtttgtacttatattgatgggaaaccagcgcactggaaggagtcggatggtctgatcgatttattgttttgttccaagatgtcatctcgcctttgcaacccccattttcttttgttaaatgcttgcggatgacattaccgagacacgatcagatgaggaactgcatccatggaatagatagagggttggactaggatcttgggtatggatgggttcgggaaagggtctgggtttgttttagggagactcctgatgccggtgtctggttgggatttagttatgcgtgctttgtccattttgttttctcttctcattgtttcatacatctaattattgtattgcttgtttctttttccttttccattactctcttgtctgtcctatggcgtttgacctttttacttgctctcgacgaataccatctttcaaatgatgttcactaatgtttatattttgtatgatatgtagctagtatcagtacatacatgtacgtatatacatgtacatatgtaggtaccccacatcctcgagtccatccatggaagttgaaaagaaagaccagtcagtttcaccacttacatacggagattctcaatcaaatcctccttcgatactccactatacatccggagtgagtgctccccacctcctgcttaaatacaggacagcggggctgtctagctgagagccaccgtccgcattccttagtgcctctagacaagacttgtcgaggcctagaatgattggactaggggagaagtagtactcagagtcagctcatatgacgtgtggcctactgtgttgtctgtgctcctcggtgggccgtactgtgactgatttcctctcaagaggattcccccatgagctgaaccctctcgaaacgatttagctgggactggtgttatgttagcgtcctctcatagcacaccatacaggatgctctacatgggcctatctcaggtacaagacagtctttcatcccgttattactttgttaatattctctcggggcactatatatcttgcctgtatcgtgctcttggtacggtggctcgcagggcgaacaacctggaatgtctataacattattggtcagcaaaatttagaatatttttcggcgctaagtagcattccgcaacccgcctttttcacgctatatattataataatatatcaaatagatcggaattggtatatactagtaagatctctcaattagaatcagtactcaacgtagtgctacccggattaaaaaccgtagggatcaaattaggtataaggtaatccacggccaaccggttaaacgatcaaccggttagccccaaaacaccatactaaatgcgatttttcaggtcacggtatatcaataaccagaagcagtttttgtatgattcttagtgccatacaaattcttaatatttgaaacagtgtagtataaccgaaatattcaaaaaaaggattatttacctaggttgccaaaaatacgcttcaatcgagggatatacagtcatgggtatttgtacctctacatatgtaccattgaccgctttttcataccgcctgcctattcccaccagtataaccgcgcgcgtatagtatactagttttatactacaccctttccccctcttttcttataaaaaaagcagagattatgccgcaccgagtagaagaggttaagacgaacgttggcatactacctaggtggttagtagctagttagaaaatccgagaaattttaaccggcagaaaaagagtgggacctaaagtactggggtgcaaatactcatggcaacatgacagtagatatatgtattaatattagttatcacaccttgaattatttctcgacctgataaaaatacttagtatattatatcaaacactaagatacccctaggactatactctttaccttaggggttaaaatatgaagttgtgaaaagtcgcatttagtatagtgtttggggctaaccggttgatcgtgttaactggttggccgtggattatgttacctgactcctacggccttgtgggtccccgcggtatatcttgcttctcgatacgataggtaataagcgctattctgggatctaaaaataaaagaaaattcatgttctatcttcagcgctaaatcaaacgtaaaccattgtcacgttctttagccttattggactacacgtactacgatcggcatactatccagttaaataaggtactggtcacagtgttggtaacagggggtttttagtgttatacgctacggcgtcctctgtttctcaaattaattttagtcaacgaatggctaatagtacatcaaggtcaggataggccatacagccactatttagtgttgggcgtgccgggcagtgtatgttgggcggtagttggttcaggcctcgttacgccttagcctatcgatcagagtgtatgatatagtggacagtagcaccattatgtataaatatctggtttatgtccttctcaattttgatttctctcatacaacaacacgcattctctcgccttctacctctatcgactgcgaaatatataagctggtgtctacttcaaaactgtctcatctctttatctcgttgtatcttatatcgatttcggttgccgacatccttatcacttgatctatctctcaagagctcccggttcctaggtgtaagaggacattttctgctttattcaaatctcctaggggaaagaagtcttatgctgacctactagctgtacagcaggaataattcgcttccacaatgaatgatccgaactgcagtcaatgcggcggggatggctaatggaaggaagaagctacgcaggtggaatatgcaactcagagaaatagataaatggactctggagaggagaaaagaagaagagagagggggaagctatctgcatacacatgaggaaagtcctaggagcggggagtcacgtgataagcacgtgaccaccccaacacccccctttaggactgacctagatacccccattcctactctccatataaaaacctctcttttttttttttttcaacatacagtctttactgcctttcctacgtattattacactcctttctctattagtaaattgcatatagatcactaaagacctagtatatacacgaatctgttatatacttccttatcgagagcttttgtgaacccgtccgctatattatatatcgtgttaacacgtagcagattgatcttctctctaaagattgcgtccttaacgaagaactagcgtatattaagctatcttatactatttttgtaagagcgctttcctataagaagctaggtgttgatattatccgttaagataacgataggttttgttatattcggtaggtttaatatagtggcgatttttattagctattaggtatcccttaccggtctattaagagcgtaccactctactactatcgataatagtgctataattgtctgcttccttaaataccacctaattagtgcaccgccgaagaaccagatagccccctctatagacttcgtattaggctagtctctatataaggcgtctatatatataaagaaagttatatcctagattctcccgagcgttatataaagctctattatcccttttaggtatctatagacctatcggatagcttatatattattagtggtaggtgctatagagcggtgttataattttataactataaacttaatatccggtcttatctctatagtgagctagtttagtctcctaataagagatctatacaatatataatctttatcgtgtaaacgggtctccgggttattattattaacctcctatttccggcttagtaatagcgggataggggttagtgtgtataactatatttctataagacgtagcgcttctagggtataagctttctaagatattataatagtcttcttactatagtcccgagaaatagcgctaccgagaaagcgtaaaggctctcctagatctttgatttcgaactactccttcgtctagtggtaaatctactacacttccgtatctattagtatagtagtaataaaattatctatataaactagcaaaaactatactattacgccttaaccttttatatatatataaggatcgttatcgagtgcgtaaaaattaatcttatttaatctagtatctagctctttattctataaagctactaaatcacgaagtccgtatagagcctattttaattaataaacctagcctttaattctaatatccggtttatagtactcgaaactaaggggttaaaatatatagactatttcctaattatcttataatatatttagatatactataactatattaaattgcttctatttataattctattatataataatagtgaaaataatcttaataagtgtgttttagacgataggtacgtagaaaatagagtcttccttctttatctagaagttcctatacactacctatcttactttaaaactatacaccttattatctttagtgactttaagattatatacctattagcttagaagcggagtgattcctagcggtcttcgaataatatcgaaagtgtcttttatatagagattattaatctaactctctatagtagcttactatctatctacaaatttagactttagagcttacttataggactaagggatatcgacgtctttaatataaagcggcttgctattataaataaagggagtgctttacttagtaagaaccttcgacactactagccttcctctctatatatcctacttatcctatccctatctagatccctcgctagcactattattaccctatagaacgtccggtctcacgcgtattatcttcgtcttcggtttcggtagagggttcggtctcgggggacgtagggggttcttagagaagctgtagcgctccggtaagcgtctcgtacggcttaaacggcggggaataaactacggaattgtcttatcgctactaattataataacggacggctaacaatcctattaaatcatactctaatcggtctcgattgtggaaatattataagaaatctcttcttatagctgtgaaatctcctcttcttattgttaaaaaggctcctaagaaatctcttcctattattaacaaaaagtggactaagaaggctcttcctctctataagagagagctttataagaaatctcttactaagtgtgtagaactagttttagagtctcctactatagtgtatcctctctaaatacacctagcaaatatagtgttagtgatttaacaactactactagcggtgtaagatctcgctaaattagtgtctcttcctctcggtaagaaaacacctatctctcttcctactaagagaccacctatctctcttcttatagagaaactacctatttaattagtttatatataaaggtcttataagtatcctcactatcgtcacgctcgatcgactagtaaataggggattccgggatcacttctagcactagaggctttataacttactttctaggctaaggtagtagtagaggaagaactaacacttccacactaagctaatctatatgctttctaatcaattcccgagcttagggttagagcgtaggacgttatatagcctatagtgtatcgtgcggtgtagcctactatttagactactatttagcctattatatcggctatctctttactagcttttggaagataggctatcgaattagagatatatcctcgacttcctagatcctagttaacactttaggtgttagtggtatagtctatactcttcctagtgtgttcggtcccactaagggttgcttttactaaattgttagctttattagaccttaaataataggttctagcttcctattagtaataataacctatagaactaattttagttaaatcctaggtcttttaaatagctatttacccttttcaatctagggtcctccctttttatagagtgctccggtgtcgttattatccgaattagggtcttttagtgctagctttctagtcggcgctagaccccctttctagtcattatccgatctagtgttcttatctagtttatctaggaaagtgacgtcctaggagcgtacaatctcttttataataggattctataccttaaagatatagccgttttctccttcgtaaccaattagatatccccggaatactcgtgctcctaacttctctaactatatataagtctctcttagaatatagacaaaaacaattgctccctatagacgaaggtgctttagattaaccttcgtttctcctatactaaggtcttactactagataataattagggttttacctattttagggtttactaggcagttgtgaatataaatagcggtatttatataaaaaggctagagagagtctagaagctttatatctatatttatcgtcctctatatttgattaatatagcctcctatacgctccgctatactattaggtttagatatatacgcgggtataagttcaaaaatcattccctcactctccccctatatctagaatttatagaattcgcttcctccgttaatacgctagatagctaggtatctaccgcggagaagcttctaccgcttataaaatttaattatatattccgcaatcttatctttagtgcgaaaataggggccctcggtgtatcgggtatagtcgtctataataggaacctaatatttctctctaccgggtccggggggatttatagtctaggtgttagtataaaatttcatactaggctttttaatatatcgttatttgtctcttaagatccgtttcttcgctttcctaagctaatatacttcacaattaaagtcgtaaagttcaacctagttatccttattaagaagaatagtatccgctaaagaagctttaatatacggtttaccgatataccctagatatctatatatttcgtatatagagactaccttactaactctattaaggtctttatctttatcgttagacttagagctagaattaggctcgtaaaaatacgtcttttagacctttattaaaatctctatttttatatcttcggcttcgctctttataccataaaaaagcgggctatcaatctatagaagtccgctaaccttcttcactaggccgacttcctcccggtttacacgtacaagctttaacgtgatcgggttataataaatcctataatctacttctagagtattcgtagaaagtagtctatctttagttaataggttatagtaggtagagataaggattgttctcactttcctagtcgaagtcttaatctagactagggccttactatatactattacgaattaaatattgctattagcattagtatagctatatagcgtttctctagctttatacttagtatatttatagaaatctttatagtgactagtgatagttttagaagcaccactatctagtatctatatcttatccgcggagtgtgcggagtttacccgagctacactagccttattttcgttcttcttattatttgctaaccgctttataatactataacactagatattcttcaccggtttctacccttcgaaaataaggtcttctataaggtggtagtatatctttactagataaccttcgatactatagtagggatatttgtagctattaacgtactatagttattagtttctttattattccgcccactagtcgatagtcttaccttttactagaccgtttttaaagaaagataacgtctctctatctatctttatatctatcttagtatctgacgaagtattatatccgccgccgcgactatatctactataaccgcgtccccttctaccgcgctagttctctatcttccgcgctacatttactatagtagaggtgcttaataaagtaggtgtatcacaagcttctataattagctttttatataagctattaaagtcgtcctttataacactctctagaatagtatcctttattatctagtaggtgaactttaccgaatctagttctccttcgagattataaagtataataaatattataccgaaagggtgcggctctaccttatataggcctagttagttatactacgtctaatacgccgtaatataggtattagcgctagagaaatctaatctccggatcttataaaacttaataactttatatctaatattatctatgatttctacaccacgaacgagagtctctacttcgcgtattataatatctatataacgtggaaaggcttccactcctcctttaagaatagtaataatctcttaatctagcagactcttaatctatctataggcaatttttgactagtattcccaaatatcgtactcggggtctgtctcctatagtcggggcagtttataattagccactttatcgatacggaccatactaagtccgttctcgatctagcgtttctatctagtaagattgctactatctagtaataacttgatacctttattcaatttaatttccttctcctccgggaggtttgtgccctaggtccgaatcggtcgtttcgctacgccggcggaggaagaaggttaggtttaggtgcgaggtgcggggagagagcgtgataagccctcaccggcgttatcatcctcggaatcagtcatattgactggctaagaaaaatgcagagtcttctcgatagaaagatctccggttagaagtagagagacgcgtcttcgctgactctcgctaagaaatgcagagttttcacgatagaaaaatctctgtttgtgaatatagagctctcttgataagaaatctctgataaagaaatgcggcctgtgatgatatcgatgaccttcactaccttgatgatggattcgatgatccttagtggggtgcgggacgggccgaagcgcgacccacaatgaaaattctgattcgctcagttaaaaattgatgaaaattgatgatactcggagtcctcgagcaaagggcttcataacctgatggaaggaagaagctacgcaggtggaatatgcaactcagagaaatagataaatggactctggagaggagaaaagaagaagagagagggggaagctatctgcatacatatgaggaaagtcctgggagcggggagtcacgtgataagcacgtgaccaccccaacaatggcttttacgaaaaaaccgtcgaagaatgggtaaccgttccgtgcaactgcggtaatgacctagactgcgaagagtgcgagggctctggaacctacacccagtggcaagcgagacgggaggaaaggacatgtgactgtcgaggtgacgttgactatgattcctgaagcctgttgggaactcaaatggtcgggttacgactgccagagtatacagcgatattcgaaatcagacataccaacatcctcacgcggattagttcccgaaccctaatccgaaacgcgctagtctaactttagtttctccctcagaatccctgctgaaatgtatcgtattgcctaacagtggtcgatgaagtaattgttataatactgtatcgctccatggaaccgcgtagaatctttattgcaataggccaaacagagcgacagttctgggggtctggcaagatcgcctctctttctcttccatcgcaggcagccttcgtccacgctcgttttacgtacactagaggctgtgctcatgcctgtagagaactaacctttgataggagatcatgctggcttgtttccatggttcatcttccttctgtgatgttcattcgctaatagtgtccgttgatgtccactgaggcgttccagggactatgactttatgcggagatgatccaaagctcttagcacactgattacatttcttcgacggaggaggctgaatcatgggtgcacaactagcagtatactccggctcgtactttcacagcccctacgccacgcaatccacctacacttccccccgtcctagattgcccgagagcggacctgattagagaggtcaatcacgaccagatagtctcgggttgttccagctttccagtgtagtgaagcatggaatgaaaaaaagattcttgacgcagattatatacaggatgctattctcaaacccgcccagatcggtattccaaggcaaaaaaaaactgtggttgactgccgagcagtggaatcaatactccggagggtgccttcagaatggtcatctactgacccttcagtagaaccgtgttggtatccgctttgggtgaaccaaatgtatgatttgcttcactaggactggagcttgacgtatttttgatgattaggtacgaaccatcatgggaagctgcacatttaagtctgctgtagcaatcctgctggggggtccccgagcttcactgttttattcttgcagccggacgccagcaactggccatcgcacacaaatatcgtcagaacatcccctccctcgaaaggaacatcatcgtcgttgagagggagagccaggctccctccgcgacggtttgttcccgctcaccgcgggacccatttcatgtacataccatgtacgcttccgcatatctacatcttcctctccaggatataagaagtgccgcaggcccgcctggggccctcacggcactgtggccctccgagaacgcgaaccctgcgctctcttcacaacaaggcctacatcaccggtgcccagaccgcgagtatctcgtagggctaaaatatctatctcactcgtctccattcgtgaatgtgtagcaatggttggaatagagtaaacacacaaaaagaaattattcggactatttattcgacgaaaaatataggaacaaaatccgccccgctgcactgcctagagcaagagttctatctttcactgccgaacacccagtgcgatactcaggaggcagccacagtgatttttgtcccgaatgactacccactcattgtttcgcacggatatcatgtcactctcttggtttgattcgaagatatcatcctgaaagctaggcctgatgttgtagaaaccaagatctgaatgtatacgacacccatctttggaaaatttcagcgtggtgatagatctctcagcgtgtaatgtttgctttagggtgcccgtagtgatatcccagagtctggtttctgaaccattgccgccagacgccaatacctggccatcgggggggaatgacactgagcaaaccgaggctaaataccttcgagggtcttctgtagagcgcctgttttgacaacccagaggcggacagctataccggagccagatattgaacgagagaatatactatagtaaaccaatactataactatatagagagatagaaaagtaaagcgagtgtgttttgtaaagagtaggatctacttagctatttaacctaactatagtaggcttacaaactagtgccactagctaactagtaagtaatacctaagtgcctaaggtggctactacatagagaaagtaaaatacaaaataaatatgtaggaagggagtccggctggcaccttgttttcttagttagagagcatgcaaataaaaggggattatagtgtagacctatagtactgattgactgtacttgatcgattatcctaagaactttagatataaggcccaaaacgcttattgcttctacccaataaaggaggtgctccttaagaaatataaatgcgtcacgtatcactaagtggaattatttgctttgactgaggtgataatctagaagcgacaagaccattgtagctctagaggaagatattagcgaataacttataattcgatatttatatagtgagttctattatatcgaagcgtatagatatttgtcttaacctttggcgtatacaaaaggtatcttgcagtcaattttgatagatctcttacttatccacctataagagagttatctgccgtatctccggatcgagaaggaagtccctaaatgataggtagacgggccgaattagcatttccgtatccttcggtatacaaataaccgagtgaagtctattcaatctcaaatcaattagtctctcagagacactaagtagtctcgagagtgacgtgatagaaagggggctcttaagtatcactattgcacctactatttcctaaaactctcgaactagctatattttcggtttctattctagttgttgatggaaggaagaagctacgcagtggaatatgcaactcagagaaataaatagatggactctggagaggagaaaagaagaagagagagagggaagctatctacaaacatgaggaagtcctagagagcgggagtcacgtgataagcacgtgaccaccctaacacccccctttaggactgacctagatacccccattcctactctctatacaaatatacagtctttactgcctttcctacgtattattacactcctttctctattggtaaattatatatagaccactaaaggcctagtatatacacgaatctgtcatatacttccttatcgagagcttttgtgaacctatccgccatattgtgtatcgtattaacacgtagcagattgatcttctctctaaagattgcgtccttaacgaaaaactagcgtatatcaagctatcttatactatttttataagagcgctttcctataagaagctgggtgttgatattatccgttaagataacgataggttttgctacattcggtaggtttaatacggtggcgatttttattagctattaggcatcccttgccggtctattaagagcgcaccactccgctactatcgaagatagtgctataattgtctacttccttaaatactacctaattagtgtaccgccgaagaactagatagccccctctatagacttcgtattaggctagtctctatataaggcgtctatatatacaaagaaagtcatatcctagattcttctaagcgttatataaagctctattgtcccttttaggtatctatagacctatcggatagcttgtatattattagtggtaggagctatagagcggtgttataattttataaccgtaaacttaatatccggtcttatctctatagtgagctagtttagtctcctaataagagatctatataatatatgatctttatcgtataaacgggtctccgggtcattattattaacctcctatttccggcttagtgatagcgggataggggttagtgtatataactacatttctataagatatagcgcttctagggtgtaagctttctaagatattgtaatagtcttcttactatagtcccgagaaatagcgctaccgagaaagcgtaaaggctctcctatatctttaatttcgaactactcctttatctagtggtaaatctactacacttccgtatctattagtacggtagtaataaaattatctatataaactagcaaaaaccatactattacgccttaaccttttatatatatataaggatcgtcgtcgagtgcgtaaaaatcaatcttatttaatctagtatctagctctttattctataaagctactaaatcacgaagtccgtatagagcctattttaattgataaacctagcctttaattctaatatccggtttatagtactcgaaactaaggggttaaaatatatagactatttcctaattatctcgtgatatatttagatatactacaactatatcaaattgcttctatttataattccgttatataataatagtgaaaatgatcttaataagtgtgttttagacgatagatacgtagaaaatagagtcttccttctttatctagaagttcccgcacactacctatcttactttaaaactatacaccttattgtctttagtaactttaagattatacacctattagcttagaagcggagtgattcctagcggtcttcgaataatatcgaaagtgtcttttatatagagattatcaatctaactctctatagtagcttactatctatctacaaatttggactttagagcttacttataggactaagggatatcgacgtctttaatataaagcggcttaccgttataaataaagggagtgctttgcttagtaagaaccttcgacactactagccttcctctctatatatcctacttatcctatccctatccagatccctcgctagcactattattaccctacggaacgtccggtctcacacgtattatcttcgtcttcggtttcggtagaggattcggtcttaggggacgtagggggttctcggggaagccgtagcgctctagtaagcgtctcgtgcggcttaaacggcggggaataaactacggaattgtcttatcgctactaattgtgacgacggacagctaacgatcctattgaattatactctaatcggtctcgatcgtggaaatatcacgagaaatctcttcttatagctatgaaatctcctcttcttattattaaaaaggctcttaagaaatctcttcctattattgataaaaagtggactaagaaggctcttcctctctataagagagagctttataagaaatctcttactaagtgtgtagaactagttttagagtctcctactacggtgtatcctctctaaatacacctagcaaatgtagtgttagtgatttaacaactactactagcggtgtaagatctcgctaaattggtatctcttcctctcggtaagaaaacacctatctctcttcctactaagagactacctatctctcttcttacggagaaactacctatttgattggtttatatataaaggtcttataagtatccttactatcgtcacgctcgatcgactagtgaataggggattctaggatcacttctagcactagaggctttatagcttactttctaggctaaggtagtggtagaggaagaactaacacttctatactaagctaatctatatactttctaatcaattcccgagcttagggttagagcgtaggacgttatatagcctatagtgtatcgtgcggtgtagcctactatttagactactatttagcctattatatcggctatctctttactagcttttagaagataggctatcgaattagagatatatcctcgacttcctagatcctagttaacactttaggtgttagtggtatagtctatactcttcctagtgtgttcggtcccactaagggttacttttactaaattattagctttattagaccttaaatagtaggttctagcttcctattagtaataataacctacggaactagccttagttaaatcctaggtcttttaaatagctattttccctttttaatctaggttattactagtcctccttattcgtaaagtgctccggtgttattattgtccgaattagggtcttttagtgctagctttctagccggtgctagaccccccttcttatcgttatccggacctttcttatctagtttatctaggaaagtgacgtcccgggagcgtacaatttccttcgtgataggattctataccttaaagatatagccgttttctctttcgtaactaattagatatccctagaatgcttatactcctaacttctctaactaaatataagtctctcttagaatatagacaaaaacaattgctccctatagataaaggtgctttagattgaccttcgtttctcctataccgagatcttactactaggtaataattggggttttgcctattttagggtttactaggcggttgtgaatataaatagcggtatttacacaaaaaggctagagagagtctagaagcttagtatctatatttatcgtcctctatatttagttaatatagcctcctatacgctccgctacactattaggcttaggtgtgtacgcgggtgtgagttcaaaaatcattccctcactctccccctatatctagaacttatagaattcgcttcctccgttaatacgctagatagctaggtatctgctatagagaagcttctattgatggcggcaacgagaacagggacagagaaagactgtattcgctatctgacagatgactgggggaggaagaaggaagagaggaagacagacagagagagagctggagacaaacaaacagataggcatgactagcctgaacaaataggcagccagctaggtcacatgacccaggctccaacacccccccttaggctagacatccactaacaaacactctcctcgcccccctataacaaaaagaaaactactatctctagtatcaaattcaccactagtatcatatctagtatcacttctttctatcctttgtatccttcttctccattcgtgctgtagcgtagcactagacctccgggaacggctcctatccattaaaaacgaattcttccattaggtggaagtatgcctttatagggtgtccatcgagacggcagtgtgtgcacttagttccgttgatatactaaggctgctgataacgctagcgcttagcctattcgtcaatgttagctcctttcgggggtgctctacgaagctgcttctcttccggtttatcctttgcttcacctttatcatcaactttgttatcttccttcggtttccgccagttatttctacgtctaatacggcctccacgaccgcgctgtccacgtccgccgcgtgaagaagacgagggtgacgaagaacgggttatcttcgctagactagggcttgtctcctctatagttatattcgactcaataatcagctctttgtagtatttaccaaagtcatttattgtggtttcggtcgggacttggcgttttagagtattaaaagtgaaattcacgctcgggagctctttacgaagtgcgtgaagtatagtgtaaagtgtagcaaaagggtgcggtgtgacaccgtaacgtccgagaatattgaattgcctctaataagccataatgtagtccttcgccgtagtgtaattccctcgtttcaatttgtcgaattttaagacctccgcaccgacgtttaaaaccttattgtcaccgcttacaatccgggtgatctcctttatcaagtcatcggcgtactccgggaattgttgaattgaaccttcgaggatagtcgtgattttattgtctagtgtcgacgagatctagccgagggtgtagacggactagtaatactaggtatcgtactccgggtcgtcttcctttggtttcggtaggttgaaatttataacgttctcgatccgggtcatccgtagtctattcgtgatttcgcgcttctagcgcacaaagttcgatctatcaacgcgtaaggtgtaggctttcatctattttatatcagttttctcactaaggcgggttccttacgtaacaggttagggttagggtacagggagccgacgagagctctccccgcgggatctagatccagatctagtgtcagacatcttcaaatcaggtttacttctaacgaacactcgcgagtaggaaaaatcagggtatcaaggtttcgcttccagcggacaaatcgcgagcgagaaaaacaggggttgcttccagcgaacaatcgcgagtagggtatcgagtatcgaatgtttcgaggtttcgagggttcgcttctagcggacaaatcgcgagcgagaaaggttaagggtgctactagcgaacaatcgcgagcaaaaagtgggtcgacgacgagggtggagctgcttctagcggacagtcgcgagctaatctctgagaaaaagtggggccgtgaaaactctgtagatcagatcagatttccacgtggggtgtcgcacaaatgacgtcactaaagcagcaaaagcattagctttatcaaccagagataaaaactgatagagtctcagttaggaaaaagcgagggctcagaacctgatggcggcaacgagaacagggacagagaaagactgtattcgctatctgacagatgactgggggaggaagaaggaagagaggaagacagacagagagagagctggagacaaacaaacagacaggcatgactagcctgaacaaacaggcagccagccaggtcatatgacccaggctccaacactatcgcttacaaaatttgatcatatattccgtaatcttatctttagtgcgaaaataggggccctcggtgtatcgggtatagtcgtctataataggaacccaatatttctctccaccgggtccggggggatttatagtctaggtattagtataaaattttatactaggctttttaatatatcgttatttgtctctcgagatccgcttcttcgctttcccgagctaatatactttataatcaaagtcgtaaagcttaacctagttatctttattaagaagaatagtatccgctaaagaagctttaatatacagtttgccgatatatcctagatatctatatatttcgtacgtagagactgccttactaactctattaaggtctttatctttatcgttagacttagagctagaattaggctcgtaaaaatacgtcttttagaccttagttgaaatctctatttttatattctctttctttatatcttcggcttcgctcttcacactataaaaaagcgggctgtcaatctatagaagtccgctaaccttcttcactaggccgactttctcccggtttacacgtataagctttaacgtaatcgggttataataaatcctataatctacttctaaagtatttatagaaagtagtctatctttagttaataggttatagtaggtagagataaggattgttctcactttcctagtcgaagtcttaatctagactagggccttactatatactattacgaattaaatattactattagtattagtatagctatatagcgtttctctagctttatacttagtatatttataaagatctttacagtgactagtgatagttttagaagtaccactatctagtatctatatcttatctatagagcgtacggagtttgcccgagctatactagctttgccttcgttcttcttattatttgctaaccgctttacaataccgtaacactagatattctttaccggtttctacccttcgaaaataaggtcttctataaggtagtagtatatctttactagataaccttcgatgctatagtagggacattcgtagctattaacgtactacggttattagtttctttattactctacctactagtcgatagtcttaccttttactagaccgtttttaaagaataactctccctctatctttatatctatcttagtgtccgacgaagtattatatccgccgccgcggccgtgtccgccacgaccgtgtccctatctaccgcgcgggttctctatcttctacgctatatttactatagtagaggcgcttaataaagtaggtatatcacaagcttccacaattagctttttgtataagctattaaagttatccttcgtgacgctctctagaatagtatccttcattgtctagtaggtgaacttcaccgaatctagttctccttcgagatcataaagcataataaatattgcaccgaaagggtacggctctaccttatataggcctagttggttatactacgtctaatacgccgtgatataggtattagcgctagagaaatctaatctccggatcttataaaacttaataacttcacatctaatattatctgtgatttctacactacgaacgagagtctccacttcgcgtattataatatctacataacgtggaaaggcttccactcctccttcaagaatagtgataatctcttaatctagcagactctcaatctatctataggcaatttttaactagtattcctaaatatcgtactcggggtctatctcctatagtcggggcagtttataattagccactttatcgatacggactatactaagtccgttctcgatctagcgtttctatctagcgagattgctactatctagtaataacttaatacctttatttagcttgatttccttctcctctaggaggtttataccctaggtccgaatcggtcgtttcgctataccggtagaggaagaaggttaggtttaggtgcgaggtgcggggagagagcgtaataagccctcaccggcgttgttatcctcggaatcagtcatattaactagctagaaatgtagagtcttctcgatagaaagatctccggtcagaagtagagagacgcgtcttcgctaactctcgctaagaaatgcagagttttcacaatagaaaaatctctatttatgaatatagagctctcttgataagaaatctctgataaagaaatgcggcctataatgatatcgataaccttcactaccttaataataatagattcgatgatccgatttggtggggtgcgggacgggccgaagcgcgacccataataaaaatttgaaaattctgattcgcttagttagacttgataaaaattgatgattttgatgatgctcggagtcctcgagcaaagggcttcataacctgatggaaggaagaagctacgcagtggaatatgcaactcagagaaataaatggatagactctggagaggagaaaagaagaagagagagagggaagctatctacaaacatgaggaagtcctggagagcgggagtcacgtgataagcacgtgaccaccccaacagttgttaataagcctatttagaactagtagatatatcttgcttagttgagatccctcacttcggagggtgaggatctcggtgagctatctatggggtcctactgcggatcatcaaaaacacgatatacggtcgtagcgaagataaatagtggaatagataatacaacaagagcttccaaatccgtgtacctaggccagttgatagggagcggtcgtttctttctgatttttgacggtctctagttgaaaaataaaaatatgtagtgcgctataactgctctatcatagagcgcgaaatcctgatagtcctgatccttgatttccgaaaaccccagccggataggcaacttaggtctgctagtcaagaagattcgtacgcttatagaccttaactcctgtagccacggtagtgaccgaagtatgactcgtacgttattatcgtgcttacactcgtctaacgcgtcaacaactatgattacgattagaatttgctgatcggatgactcgaggactagcagtggttgaagaagtagtttctcgaattgctcttttagcgattttactgcaatatcacggtcgttatagattgcttttcggacactaggtacgatcttaggaaacctaagacctaactatatagctatgtcgggaaaaaccttatagtattcccccggtccccttcacttctcttgaaaaaggagcttgcacctagtcgcttgtcctgcttgaaggattttgaaactgtgcgggaaactgtagatttaccttgcggtgaaacagcctattctgtgattttgcgaaggagctcggttctggtgcctaggagacattcatcctcgtgttgatcctcgtgttgatctatatatgagtcaaactcggccctatgcgcaactagcaacttgtcaagactaaaatcatggcgaatatcttctgctttgcgagccacattggctaggatgatactaaggaggtgtaaaccgatcttacccgagcgatttctgtggagaagtttacctatggccaacctgcaaagataaagtaaaggatgatttgtatctctcgagatcccgaattatccatctcagagcgtttgagcgccacttcaaggcgcgaaagccgaacctccttatcctgttctgccccgtcccaggattaatcttcttttcagtgtcccgaggtctaaaagacaatcagtaatatcactgactaacgacgaggagctgggcagctttgtgctgtctacattagaatcttgcagcaatcctttgagtttctgaagaatctcttcgagacctgcgaccgtccgttgtagggtaataatatcatctcgtgcttccttgacctcctgaacgtaacccccacagatattcacaagaatattcacaataattcccgtgagttgaatgactgcaattacactagctgcagacgaaagtccttccatattgggaaatcactggagactcaatggtaaggtcaagagaaacggggtttgcaggaatcgagacgagaaggatacgcgggaggggcggaccagaaggaggcagaggcggtgaatgaggtatgtatatctattagcgggaatggggaccaaccatctaactcacagatgacgtttaaaagaaatgggtgaggaggtccggtaagagtaagggaagggacacacggactggagacagtagcatgtgtataggggtttcgtgtaaaaaaaatcgttcaaggaggtctcacaaacgtcacgtaaaatacaaggtctattctgggaagcgaaggatctacggccataccatatttagcgtgtttttggctagggttttgaggatcaacacgagagtgtatggtggtatatctgatttcaaatattgctgtataggcgcttttcttacttccgcgctggtacttaaggatggaaggtgataaggctgtgtggcgagtcccgtgacgaggcttggttagcgttgctagatgcccgaagacaggaatccttgtacgccatttgaggccgaaccagtcgtttagttagcttggaaagattcagttcacgtttcttgacctctcaatgacctcttgaagcctatctctacctcttccttcaagtacatactccatgagtgtgaggatggggaaatggagtctacggaacgtggctggatgtattgatgtatgctatagaaggaagaagtaacttcactgggccattgaggtggaagcttagtaaactaggtagctgatccatggataaatcgaacactccgagtcagaaccgtggtaagagaatacaggttgcctcgccagtcacatatgggttaggccgcagtcgataaaaactgataagccctgaccgcacacaacttgagcaagagcttaagcaggaccttagtagtgggacgaatgtacctctccatattatccaagagtctcacgagcctttatatacatacacctccagtatattactggcgatatatttgaccaatgaaggaagtaactacctaggtaactaattaggtaacgtaatccacggccaaccggttaacacgatcaaccggttagccccaaacactatatactaaatgcgacttttcacaacttcatattttaacccccaaggtaaagagtatagtcctaggggtatcttagtacttgatataatatactaagtatttttattaggttgagagatatttcaaggtgtgataatattaatatatatatctatatccctcgattggagcgtatttttggtaaataatccttttttgaatattttagttatactacactatcttaaatgttaagaatttgtatagtactaaaaatcaaacaaaaacggcttctagttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggattggtaatatgacccccccccccccatctttacttgacccccccccccctgcctgaaaatgcctgattttcagtaccgccttcccgatcgggtgcgaccaggatttctgccatacgttctgccagtgcagagttttctgccatataattctgccaacactgtaggaattccggtttatatagtaaaaaaacatgcattttaatcagaaaaaaacgtacatttctgccgaattaagcatttgtttacacatataggttaaatgagcttctcaaccaggtccccgcgcgcgctatccccgtcctcggccccgtcctcggccccgtccctgtcctctagtctcggtatcaccactaccagtttcaccactgcttattccacgcctacgtccccttcctcgtcctcgtcctcgactctcctcctataacgaaggatctcggtgtatagaacgatcctacgtgaggggattaggtcaagactgtagttgctgggtgcttgcctacgtgcttgcctgcgtgcttgcctgtgtgcttgggaggttcctggtaccgcgagggcgtcctcgttgacggactggaaggggatcttggatgagaagtatcgggttaagcgggggggcatcgacactatctaagtgctaatgctgatggtatagcgctagttctaaagatcgctgctccgtattgtattactgaatgatatagatatatggaaagctagctatttctttagaattgtaagtgtaaattggtggaactaggggtttgttatcgcctggcggtagataccgtacgtaaaccgctttagtaagcttaattgcgcgtattgaaatccgggtgtaaaggagcttgtaaagctgtgggatatatgctagccttcgaatcttctactccttaattctatactagattttagagaattgatactctatagaccggttaaagctacggagaactcctagtaaatcatgatttaagacccggagaccctactttagtagctaatacgcgctctctatacgggatatagcgatcttattgagatagaggtatttgtaaaggataaaggtcctttcaatcatgaaacagggaatgacaggatgtgcgtagcatgtatcgtaatcaatgcgtgcggggttcgctaggtgatcggccctacttcttagcgcactaggattttcttttaatcctagggccccccgggggccccccctgatttaggataagagttagtcttattatatagaggcaatacactttcattcctatccccgctattcgtatcttacccggttaataggccttatacctaataactatatatctttacaattctaactcttcttcttcaaccgcctaagatataatagctcccccggttacccgtagcggcttataaaataacaccgaagcgcccgagtatctaagtcggatcggtagcgaatcactaacgtctaccctaggcgaggaactaagggagacctaaatctaaagaaactcgcccgagccgaacgacgaaccactcgaggaaaactactagtttattaataagataatccgaagactcgagctttaggctacggagtacgaagtaaaagcggctttataataacgaatccttatagctaaaaaattagttatagaaaataagaaaaagctctaagaactagtaggactatcgaaacgacctcgaaacgatcgcggttcctctatagagagtgagtaaagctagaaaggagagattaagtaggatatcggtaagttcgaagagaactttagtattaagtagagagaagactagttaaataaccttaatatactctttagaggagccccgaagaagtatatcttaggagcctagaaagtccttatagctactaacttcctctacactatatataaaggtaagtaggcgatttataaacgaaagtaccctaaagatatattaaactaggaggccttccgagaatagacgaaaatattacttcgaaatttatataatattattactaatatccttatcctattctaagagataataataaggtcttactaagactctcggaatttcgaaaactatctcgaatcgctagagaatcacctaccgaaatagaccgaagagtaaaaagcctagacactttttataaagctatagaaacccctctaagatattataattataaatagtaacggatcacttcctataaaccgagataagatattaaaattagtatctatcctttactatatccactttatatattagaaaaagaaagactacttaccctaataatataataagcgtaaatagggaaactattatagttcgataccgaattatccccgcaccgaaatattaaggggtcgcggaaaaggatagccttatagaagaagctaatttagaggtagagctagaggacgtagatgttggagcctgggtcatgtgacctggctggctgcctgtttgttcaggctagtcatgcctgtctgtttgtttgtctccagctctctctctgtctgtcttcctctcttccttcttcctcccccagtcatctgtcagatagcgaatacagtctttctctgtccctgttctcgttgccgccatcaggttctgagccctcgctttttcctaactgagactctatcagtttttatctctggttgataaagctgatgcttttgctgctttggtgacgttatttgtgcgataccccacgtggaaatctgatctgatctgtagagttttcacggccccactttttctcggagattagctcgcgactgtccgctggaagtagctccaccctcgtcgtcgacccactttttgctcgcgattgttcgctggtagcacccttgacctttctcgctcgcgatttgtccgctggaagcgaaccctcgaaacctcgaaaccttgataccctgatttttcctgctcgcgagtgttcgctggaagcaaacctgatttaaagatgtctgatactggatctggatctggatcccgcggggagagctctcgtcggctccctacaccctaaccctaacctattacgcaaggaacccgccttagtgagaaaactgatgtgaaatggatgaaagcctgcaccttacgcgttgatagatcgaactttgtgcgctagaagcgcgaaatcacgaatagactacggatgacccggatcgagaatgttatgaattttaacctgccgaaaccaaaggaagacgacccggagtacgatacctagtattactagtctgtctacaccctcggctagatctcgtcgacactagacaataaaatcacgactatcctcgaaggttcaatttaacaattcccggagtacgccgatgacttaataaaggagatcacccggattgtaagcggtgataataaggttttgaacgtcggtgcggaggtcttgaaattcgataaattgaaacgagagaattacactacggcgaaggactatattatagcttattagaggcaattcaatattctcggacgttacggtgttgtaccgcacccttttgctacactttacactatacttcacgcactttgtgaagagctcccgagcgtgaatttcacttttaatactctaaaacgctaagtcccgaccgaaaccacgataaatgactttagtgaatactgcaaagagctgattattgagtcgaacataattacggaggagacaagccctagtctagcgaagataacccgttcttcgtcaccctcgtcttctttacgcggcggacgtggatagcgcggtcgtggaggccgtattggacgtggaaatgactagcggaagccgaaggaagataacaaagttgataataaaggcgaagtaaaggatgaaccggaagagaagcagcttcgtggagcacccccgaaaggagctgatattgacgaatgggctaagcgctagcgttgttagtagccttagtatattaacggaactgagtgcacacactgccgtctcgatagacaccctgtaaaggtatgcttctacctgatagaagaattcgtttttgatggataggagccgttcccggaggtctagtgctacgctatagcacgaatggagaagaaggatgcaaaggatagaaagaagtgatactagatgtgatactggtagtgaatttgatactagagatagtagttttctttttgttataggggggcgaggagagtgtttgttagtggatgtctagcctgagggggggtgttagagcctgggtcatgtgacctggctggctgcctgtttgtttaggctagtcatgcctgtctgtttgtttgtctctagctctctctctgtctgtcttcctctcttccttcttcctcccccagttatctgtcagatagcgaatacagtctttctctgtccctgttctcgttgccgccattagtagatccgatagaagattacaaaatttaataaactctaatataaactcctagactactaaaaaaggaaatagtaccgtttcggtaccggaaggtacctattttatctattaagataagaatcactagataaacgagtacctatagagaggaaccctaatctaagtattaagagtaaattaaactagatagtagggaaaagtagaggagctagattaattcccgataccctagcttaatacccgctaatcgggactatagtacgcctttatataccgattaccttaggagatagtcgcgaaatatatatagatctagacactagcgcggaatataatatagttagtaaggaatttactattaaaaataaattactagctatacctttctcgttcctaacgctaaaaggcgtcgctctagatagactctatatctatagtatattctaggtactatttataataagagattctcgaggcaccgaaaagatagtaaaacgaccctatatcggtatcgatagggacttaaggctaaaaggaagccctatccttttattaaagacctttattaataaattcgacgttatcctataatctagtgtcgataaatagtggttcggagttaaagggttcgaactctagaaaccttataagtttataaagtaatctaagaatatagctattatttacgccctaattaagatactaaaggaggtatagctacccgataaatgtaccgacgtactagtaaagaattaagaccgaatcccctctaaattagaggagtattaagacgtattcgactataaaaaagcgggtatactaccgaggataaaagcttctaactatactatcgagctcgaagaaggtaaaactctaccttatagtccgatttacccccttttataaacggagcttaaagaactataggcttatcttatagataatattaaaaagggatagattagactatcgaaaagtctagcgggagcgctaatcctatttatcccgaagaaagatagaggactatatttatatatagattactagggacttaactatatttcggttaagaatcgctaccctttacctctaatatcggaaatccttaaccgactttcgggagtaaaatactttagtaaggtcgacgttaaagacgcttactaccggattcgactataagaaggtgacgaatagaagatagcctttcgaacctaatatagccacttcgaatatatagttatactattcggactatctaatacgccggccactttctaaagttatatctatatagcgctagtaaggctagttaacgttatttatatagtatatctagataatatcctagtttttactaaggactataagtcctattcgatagcgcttcgctagattttcgaaaggctatagaaggtagagctatatataaagctttcgaagtgtatattctactaaaaggaggtcgaattcctagggtttattatagatagttcgggagtgaaaatagactagagctatatccgcgtgatctaggaatagtaagaactaaagagctactataacgtctaggtttttctaggattttataatttctaccgccgatttattaaaggatattcttagatttctttaccacttatatctataataaaagggagtaataataggaaaaagccgggttaagtaacactaaataagaccgaattagtagcgttttaaaacttaaaaggggctttctagtcggcgtccctattacgctatttcgacctagagaaatatattagattagaaatagatacgtcgaactaaggaataggaggagtgctttcctaacctaataaatgttggggtggtcacgtgcttatcacgtgactccccgctcctaggactttcctcatgtgtatgcagatagcttccccctctctcttcttcttttctcctctccagagtccatttatctatttctctgagttacatattccacctacgtagcttcttccttccatcaggttatgaagccctttgctcgaggactccgagcatcattaaaatcatcaattttcatcaagtctaactgagcgaatcagaattttcaaattttcattatgggtcgcgcttcggcccgtcccgcaccccactaaggatcatcgaatccgtcattaaggtagtgaagatcatcaatatcattatagaccgcatttccttatcagagatttcttatcaagagagctctatattcacaaatagagatttttctatcgtgaaaactctacatttctcagcgagagtcagcgaaaacgcgtctctctatttctaactagagactcttctaatatcgtgaagactctatattctagctagtcaatataactaatttcgaggataacaataccggtgagggcttatcacgctctctccccgcacctcgcacctaaacctaaccttcttcctccgccggcgtagcgaaacgagcgattcggacctagggcataaacctcccggaggagaaggaaatcaaattaaataaaggtatcaagttattgttagatagtagcaatcttactagatagaaacgccagatcgagaacggacttagtatagtccgtatcgataaagtggctaattataaactaccccgaccgtaggagacagaccccgagtacgacatttaggaatactagtcaaaaattgcctatagatagattgagagtctactagattaagagattatcactattcttaaaggaggagtggaagcctttccacgtcgtatagatattataatacgggaagtggagactctcgttcgtagtgtagaaatcatagataatattagacgtaaagttattaagttttataagatccggagattagatttctctagcgctaatacctatatcacagcgtattagacgtagtataactaactaggcctatataaggtagagccgcaccctttcggtgcaatatttattatactttataatctcgaaggagaactagattcggtaaagttcacctactagataataaaggatactattctagagagtgttataaaggacgactttaatagcttatataaaaagctaattatagaagcttatgatacacctactttattaagcacctctactatagcaaatatagcgcggaagatagagaactagcgcggtagaaggggacgcggttatagtagatacggtcgcggcggcggatataatactttgtcggatactaagatagatataaagatagatagagagacgttatctttctttaaaaacggtctagcaaaaggtaagactatcgactagtaggcggaataataaagaaactaataaccgtagtacgttaatagctacaaatatccctactatagtatcgaaggttatctagtaaagatatactaccaccttatagaagaccttattttcgaagggtagaaaccggtaaagaatatctagtgttatagtattataaagcggttagcaaataataagaagaacgaaaataaggctagtgtagcttaggtaaactccgtacgctccgcggataagatatagatactagatagtagtacttctaaaactatcactagtcactataaagatttctataaatacactaagtataaagctagagaaacgctatatagctatactaatactaatagtaatattcaattcgtaatagtatatagtaaggccctagtctagatcaagacttcgactaggaaagtgagaacaatccttatctctacctactataacctattaactaaagacagactactttctacgaatgctctagaagcagattataggatttattataacccgatcacgttaaagcttatacgtgtaaaccgggaggaagtcggcctagtaaagaagattagcggacttctatagattaatagcccgcttttttatagtgtaaagagcgaagccgaagatataaagaaagagaatataaaaacagagattttaataaaggtctaaaagacgcatttttacaagcccaattctagctctaagtctaacgataaagacgaagaccttaatagagttagtaaggtagtctctatatacgaaatatatagacgtctaggacatatcggcaaaccgtatattaaagcttctttagcggatactattcttcttaataaggataactaggttaagctttataactttaattataaagtatattagctcgggaaagcgaagaaacggatcttaagagataaataacgatatattaaaaagcctagcataaaattttatactaacacctagactataaatccccctagacctagtagtaagaaatattaggttcctattatagataactatacctaatacaccgagggcccctattttcgcactaaagataagattgcggaatatataatcaaattctataagcggtagaagcttctccgcggcagatacctagctatccagcgtattaatagaggaagcgaattctataagttctagatatagggggagagtgagggaatgatttttaaacttatacccgcgtatatacctaagcctaatagtatagcggagcgtataggaggctatatcaatcaaatatagaggacgataaatatagatataaagcttctagactctctctagccttttcgtataaataccgctatttatatttataaccgcctaataaaccctaaaataggcaaaaccctaatcattacctagtagcaagaccttagtatagaagaaacgaaggtcaatctaaagcaccttcgtctatagggagcaattgtttttatctatattctaagagagactcgtgtttagttagagaagttaggagcataagcattctagggatatctaattagttacgaaagagaaaatagctatatctttaaggtatagaatcctattataaaagagattatacgctcctaggacgtcactttcctagataaactagataagaacactagatcggataacgactagaaggggggtctagcgccgactagaaagctagtgagattcggaaaagatcgcatggtttgtattgagttagctttgccaacggctaagtactatggaatacggtaacgatagtgtacataagtgcagaaacgggtccatatagatccggctaataaggcataagatatatttacataaggaaatgggcttctaggatcatatcctcccctaccgaataggaaaacggtcctccgtttcccgaaggtcacgtgagagagctcaaaaactccccctagatcccggaaaggtatcgtcaacagacgtacgtacaaaatcgaattcgttaaaggtagtgtaggtgtgtaggggtataaataaaggaaatacgttagtaagtctctaagaatagtagcaataaaggtctttaagcctttataagactcggggtcttcgataggggcctaaaataggtagcgagggtgtaaaattagcttgctagcggttattaaagggaaatctaagaggcgtttagataaaggagggtgcttctaaggtatagactctacctattagtgtccgtgggttgcctaaaggactctcacttccgactttataaataagaggaccctcccacttcgagatagtgtagtatttcctatatagcttcacttctactctcttcccttctttaccaccctactttcacccccttttatccccctttcttatcaattttcatcgattcttatccgtataaacgcttttatatcgaagatacttcgtcgaagtccttataagcgccctagcgagtcctcggggactactaggagtttcactactaccgcgcgggattctattaagcccgtagatactaagcctaggcgtatatcacttatttttcgtaagtactataacgcggagccgggaccctaggatatagagctaactaaggccgcgcgtatcgagcggtaggcgagagagttatacgtaaccctagggaacactaaggtgactaggtccggtaaggtcgatattaataaggtaagcctcgttctcgtgaaccttctagaggaaggacaccgaggcgacgacttctattaagctagttagatagccgcccggaagcaattaggtgttttcgataagtttccccctcctctaagctctcctaaagctctcggaggcataggcggcgatagtgatagtgatagcaatagtggcgtagccggtggtaatagcggtgcggctagtggtgacggtagcgtaggaggtgataacggtagcgtaggagtaggtacggttacggccggacccgcgggtataggtagaggtgctagaggtgtggttgctactccggttattactaactatagcggcgataggagttagttatatattctacttcctatcccggctactactactcgttcgtaggcctaaaccgacgctagtaagtttttccctactctaaccgtgcctatttagaggctaactacttcgttctaggtaaaggagtggacgctactaggatacctctctttatacttcttataaagagttcgtaggaccaattatagtactatatagaccctaagcgcactagagttaattagcgcgtcactaaggactatacggtatcctcggttataaacgtatatatagccctaggccaaataattggctataaagcccctttaggtgaagcttacgcgtcttataagaaaggtaacggtctgttttccttttaccggatcgttttcctcgccgggttaggtttctagtggtcgttattatatacttactactaatagtctagtgcggctaataaatatacccttcgtgagtaccttttcgggtggttttatcttcgcttcttttctaacgtcttctaggcccgatcggcgatcttactaataatcccgataataactataagactctattctaggtatataacctcgttcgccgcttctagcctaatagtatcctacttaaggccccgaatatactcgtttataccgatagaccttctcgtgcgggtaagaaaaaggctagtaaggagaagggacgagctattagtcctagtaaggctcctattgatcctattgctacacctcccgctaaggataagggtaagggtaaagctatcccggcttccgctagtctagctaaagccggtagtgctattaccactccctctaagtctataaagaaacgtacggctagtgacgcccctagcggtaaggataagggtggttagaagaaaaagcgtactaaggatacgcctaatcctcctaatactatatataccacgccccgctccggtccggctttcgatagtgtgatatacgcgactcccttagactagcctaatatctactatacagaggataagctatagttctataacgtttacgaacgtctctaggaagtgcgtaagcgcgtccggtataattataccgctatataggatctagggcttaagaagggttagctaaaggagggtgatattactaaagcggaaggtgacgggtccgaggatagtagttcggactccggtgatattctgaaccattaaggataaggtagacggatccttatagttagttttcgggccttataccctctttctgcttatattagttctcgttaaggccttatacctctattcgcgcggtttagcgatagtttctattaagtcctaccccttctaggcggctccttcggcgttcttaaggctggtaatacgattctaatttcctaattctagctttatatagacgtaagctcttagatctctctagacgggggtagaataataactacgaaggggtgcgaggttcggcccgagccttatttagactcgcgataagcgtcctctaccgatttatacccgtcggattcgttttatttaaaatccttagattcgtagtcgtttacttccgagtcccactcgttagcacctagcgggccctactctagtgccttattaatagttttcgtctatctcttacgcgcggctactcgcgtctttacgataacacgtttagctataacttcctcccctaggaattctatacgggctcctacgcgcctaaattcctactattcctcccttataaacgtagagaggtccgcgtacgtcggtagagggggttctaccttatcgaggattctatagagttcttccgggcggctaatcttttagccggctcgttatagagccgaccggccggccggcgatacctataggctaggattatcgccgacgtttacgtccgttagtctcacaccgttaataaggttccggagaatatatccgtttagttcggcgagggcgtaagtccctaatagataggcttatataaccttatatagcccgaaccatatactctcgaacttctactttactttattccttactaggacctaatcgtcgattttgaagctagtcttagtgactatagagtcccggatcttttgtttccggatagtatagacgagtaggagctcgtttgccttcgagcgggcgtctataagctactagatttgcttgtcccggttagttccttcctaggcgtccggcggctcacctccgtctacgataatacggggatatatactatagactaggaagtaggggctctttcgagtgatagcgtgctcctatatataggcggcgaatagcgcttttataagatattcgtcctaaagtcttataggcttacctataaggtatttcgtgagtatacgagtaataaggccgttaaaattttctaccttactattagtgcggggatagtagggtgttatcgtatagtaataggctcttagttgacttataaagtgtcgtacggctcccgataaaaggttagcactattatccgagagtaatttattaaatacaccgtagtgtgtatatatatcgcggaataaaaattctataagcgtctccttagttatatctaggaccgtataggcgaccggctagctagttatatagtcgatcgctataataatctatcggttcctattcggcgttattaggagggggccgataaggtcgattccctaacgctcgaacgggcggataccgcttatcactatatattatatagcttcctattcgaggtccttataggaaccctataaaacctagcaatttaggtagttctttatagactcctctatatccgctcggatcgatagccactaaccccggggcctaataatactattaagacccaggaagccgaggtagccgaacttataataggccgtccggagtagctcggagcgaaataggggatctaggtatagagagataacgccgtcttcgtatataaaaacgagttattagttttcctctataggagcccgcgcgaatatattagtgttttataagctaagtcggtcggtatatttcttcactacccttctaatagccgggtcctccggctccgtactatcttataagagctagattatagccgcgagctattcttcttcggggatactatacactatcgttataagcgtaaggtatctaactctaataggcctctcgaggcttatattagctcgggtggttccgactaggtctagccggcggctaatagtatccgctataacattctccgagccctttcggtatcgaatagatagccgatactactagaattcggcgatctaccgcgcgaggcgcttactatactcccttatagtatttaggtattatagggacgtattatcggtaataataatagtctcgaaccggtctccgtcgatatacctatcttatatacggatagcttccttaatagctagtaactctttcttatatatagggtagtttagctcggcgctatatagcttccgcccgtcgtataccactaggtagagttttccgttatcgtcctcctatataaggactataccgagggcctattcggaggcatctatttcgataacgtatagtcggttccggtctagttatttaaggaccggggcggaagcaaagaggtcctttaccttccgaaaggcgctctcgtaggcttctatctagataatagggcggaaacgttatttacgaagtgtactatcactttcttttaggagcttatagagtagcacgtatacctttaaaaagtcgtgaacgaatcgacggtaataagtggctaagccgaggaactaacggacgttatagatagtttttagtcgcggctaggcctatacggcttcgactttagccgggagaggctatatcgttctatttctaacgatataactataaaactctagttcctaggtcgcgaatgtacacttagtcggtgacacgtatagttattacttctataagagcgctaggacttcttctatatatttccggtgctcgttaagcgtagctaagaagataaggatatcgtcgagatataccactatattatagctaaagaggggccgtagcgttttattaataatagattagaaggtagtaggcgcgttatatagtctaaatagtatagcgagctattcgtattttccctagatagtattaaatactattttctcgatagaaccctcccctatacggatctactaatatccggctataagatcgatcttagagaggatccgtgcgttcccgataatatctaataactcctagattcgcgggagggggtatccgttctttactattatattatttagggctcgatagtcgatatatattcgccacttcctattcggtttccgggcgaaaacgaccgggaagccctatacgctattagactcgcggattaagccctttttaataagatcttcgacttatctagcttactcgtcgagcttctcggaggagagtctatacgcgttaatattaataggtatatacgttcctatatcgatttcgtgcgccacgttacgttccgggggaagtgcggtaggtaattccgctcggaagagatccttatatctcgtaaggatccgctaaattccggggtcgtcgctcttaggcggccccggttcttcgttcttatatccgcgataagtcggacggactgtgaaaaggtaggcttcactccctgatttccggaggagtcggcgtatttatttagccgatattatattaaggtatgtgcttccccttgtgataacgcgggcgttatttatagggtgaatagcgtatatacgatagttataatccgtaagggttataacggatatacgctagtcgatatataggttttctacctagaggaaatctcggccgaggattatatcgtactcggtcgggaggatctaggccttaatctgtcctatctagttcccgaccttaactaggaggatagtataaccactcgtttctagccgctcgctatttacgatagtgactagtaccggggtcctaggttttcgtacccggatctgtctatctaacttcccgaggacctatagggagacgaatatatcgcttactccgctatctaggagcatacagatagatattaggtcggcgtctcctatatagatctttccctagtaaaacgttagggagttagtgaggacgtttagggacacggatagatacgggggtctttccctccgcccctaccgagatagcggagggggctccgtttaggcccgtttataggagtttatagggtaataagggtcgagaatattatctatatcgaataatagtagctcgggagcctattataggcggctaacgagggcttctacgttatatagccgcactagttttttataggttagcgggatcgttcgtataccgccttttacttccgttttatctccttagttttcggcttccgatagaaacgggctaggtacccccgtttcctatagttataatattctcgggtctccttaaatagtagtggcccctatgcggtataagcctctatagagctaacgatagtattaatatctatagcgtctaggtatctcgccgaagaccctttatatctctaggcgataacccgcccttactcgtactaggcgaaacggaagataacgtccttaatcgttttaggctagtctcgttccttagcctatttagtatagtaggtagcttttgtgcctataacgaatcgctagatcaatattaggtccggaatatcctaattaaagtcggatataacctactagagattcgcggcgtactcttatacggattagttcccttatttaagcgtttcgtagcgcttatagagtttctctatagataggtgctccgcgaattcctatttaagccattccttaaatatagcctatattaggaagttatccgtaccgagtaagttatattatcgctcgcgctattctagacgctactaggcgacctttacgagcttcctagaggtatatagtatctttacctcgttaggagagtcgtgaccggtaagctttgctagctccgagaagtatcgatcgtagtcgcgcgtctatttacgggcggcgtcgttaagaatagcgctatcgtagttagcaattgcccgtaagtcgtttaggaacctcttataggtgtccttgtctatagcttaaaagattgtggctatagacgatagaggcttttcggaggtgtttagtagcggctattctcccctagaagggaggtctaacctataggataggtttacggctatactaagggccgccgtaagtcgttcggttttagaccgttccgcctagagggcctaagccctattcgtagcccgttcgactaagggattgacctactaggggtctatagtggaatatatatacacgaagatatttcgttcctccacttctagaaggttaagggccgtattaacctctaccgggaggttagctataaattccgcttcggtgtttccttaagagggctacgcggatataattgtttcctagcggggacgatagggggttcttttctttcttagaggaagtaaataataagttctatattcctcttattaggttaggaggccgtctatcttttaacggcgcctagatacggatcttactaggtagcgggacctctattcccgcgcggatcggtatttccctcggatagacgttcacggattcgagatttctctcggagcgacgtgttcgcttaggggctaagattccgtccggccgcgcgggtccttataaatctatatttctccgtagattgcgcgatttttgttaatagacccactccgggtctaggaggggacattatctcccgtgtttttccgttcttccctctcgttctcggaatctagtgtaccgagagagccggaggggagggtagaggaaaggagggagaaaacgaggttttgtgagcctccctacctagtatctaggtccgtagaatcgttgtcgggataggacgagaggggttagcaccgttttcgccctactagacgtatatagtgccgtctcgtgcctccctaggccaaccgtagaaggtggcctataccgacatgctaccagataagattcggaaaagatcgcatggtttatattgagttagctttgccaacggctaagtactatagaatacggtaacgatagtgtatataagtgcagaaacgggtccatatagatccggccaataaggcataagatatgtttacataaggaaatgggcttctgggatcacactagcactaaaagaccctaattcggacaataacgataccggagcactctataaagagggaggaccctagattgaaaagggtaaatagctatttaaaagacctaggattcaactaaaattggttccgtaggttattattactaataggaagccagaacctatcatttaaggtctaataaagctaacaatttagtaaaagcaacccttagtgggaccgaacacaccgggaagagtatagactataccactaacacccaaagtgttaactaggatctaggaagtcgaggatatatctccaattcgatagcctatcttctaaaagctagcaaagagatagccgaaatagcagtctaaatagtaggctacaccgcacgatatatagtaggctatacaacgtcctacactctaaccctaagcacgggaattaatcagaaagtatatagatcagcttagtgtggaagtgttagttcttcctctaccaccacctcagcctagaaagtaagctacaaagcctctagtgctagaagtgatcccggaatccactattcactagtcgatcgagcgtgacaatagtaaggaagcttataagcccatttcacacacactagagagacagacagtttcttagtaagaagagagataggcagtttctcaataggaagagagacagatattttcttactaagaggaagagacaccaattcagcgagatctcacaccgctagcagcagttattaaatcactaacactatatttgccagatacattcagagaggatacactatagcataagactccgagaccagttttataactagtactacaaccagtactacaaccagtactacaaccagttctacacacttaggaagagatttcttataaagctctctctcacagagaggaagagccttcttagtcaatttctcaacaacataaagagatttcttaggaccctttttaataaccagaagaggagttttcacagccgcgagaagagatttcttatgatatttccacgatcgagaccgatcagagtatgattcaataggatcgttagccgtctattatcacaatcagtagcgacgagacaattctatagtttattccccgccgtttaagccgcacaagacgctcactagagcgctatagcttccccgagaaccccctacgtcccccgagaccgaaccctctaccgaaaccgaagacgaagataatatatataagaccggacattccgtagggtaataatagtgctagcgagggatctagatagggataggataagtaggatatatagagaggaaggctagtagtgtcgaaggttcttactaagtaaagcactccttttatttataacggtaaaccgctttatatcaaagacgtcgatatcccttagtcctataagtaagctctaaagtctaaatttgcaaatagatagtaagctactatagagagttagattgataatctctatataaaagacactttcgatattattcgaagaccgctagaaatcactccgcttctaagccaataggtgtataatcttaaagtcactaaagacaataaggtgtatagttttaaagtaagataggtagtatataggaacttctagataaagaaggaagactctattttctacgtacctatcgtctaaagtacacttattaagatcattttcactattattacgtaatagaattataaatagaagcaatttgatatagttatagcatatctaaatatattataagataattaggaaatagtctacatattttaaccccttagtttcgagtactataaaccggatattagaattaaaggctaggtttattaattgaaataggctctatacggacttcgtaatttagtagctttatagaacaaagagctagatactagattgaataagattaatttttacgcactcgacgacgatccttatatatatataaaaggttaaggcgtaatagtatagtttttactagtttatatagatgattttattactaccgcactaatagatacagaagtgtagcagatttaccactagacaaaggagtagttcgaaatcaaagatataggagagcctttacgctttctcggtagcgctatttcttaggactatagtaagaagactattataatatcttagaaagcttacaccctagaagcgttacgtcttatagaaatatagttatacacactaacccctatcccgctatcactaagccggaaataggaggttaacaataataacccggagacccgtttatacgataaagattatatattatatagatctcttattaggagactaaactagctcactatagagataagaccggatattaagtttacggttataaaattatatcaccgctctatagcacctaccactaataatatataaactatccgataggtctatagatacctaaaagggacaatagagctttatataacgctcgggagaatctaggatataactttctttatatatatagacgccttatatagagactagcctaatacgaagtctatagagggggctatctagttcttcggcggtacactaattaggtggtatttaaggaagcagacaattatagcactattatcgatagtagtagagtggtgcgctcttaatagaccggtaagggatacctaatagctaataaaaatcgccaccgtattaaacctaccgaatgtaacaaaacctatcgttatcttaacggataatattaacacctagcttcttataggaaagcgctcttacaaaaatagtataagatggcttaacatacgctagttctttattaaggacgcaatctttagagagaagatcaatctgctacgtgttgacacgatatataatatagcggacgggtttataaaagctctcgataaggaagcatataacagattcgtgtatatgctaggtctttagtgatctacatacaatttactaatagagaaaggagtgtaataatacgtaggaaaggtagtaaagactatatgttaaaaaaaaaaaaaaagagaggtttttgtatagagagtaggaataggggtatctaggtcagtcctaaaggggggtgttagggtggtcacgtgcttatcacgtgactccccgctcccaggactttcctcatatatatgcagatagcttccccctctctcttcttcttttctcctctccagagtccatttatctatttctctgagttgcatattccacctgcgtagcttcttccttctatcaataaagaagggcgttagtatcctatcgctttctagtcctaaaagttcttagggctcgaatttaactatataataccggattaggagctattcgctatcgtttattccttctaatattagagacactatctagatagtagtaagtatcctattaaggtgctattagattatactaatctacgtatatttataacgtagtaaaagcttaatagccgataggcgtattagtatatatttcttacaccttttaactttattataaagtatagacctagaaagacaaaccctatagataggctttctaggattcctaactccgagcgagtaattataggagaggaattaacaatcccgatttaaaaccgaattatagacgattaacccctagacctaagagagactaaggagaaaacggctctaactatctaaaggattttagaagctaaggatctaaatatagattataagtataatttagataaatataacttagaattctagtttagacttagttaagagactatatagggagatcctaggtctagtataactactaagataatagtaaattacgtaagtatagaaatagataactagtctaaatagcgagaattatataacgaattaaatattctattcgatattatagatactataatagtagtaatctagtctattagtatagatattatagatatactcgaataagtaggaaaactctaatcggataacctagagataaaccgccgaaaaggtaatatatcgatctcgaaacctagtagtaaaggctagttagtcgacgctttaggattactatagtaccgaggacgtctatatatactaggaaaggaaggtatctatataaaattaatataattatattataataaccctactataggctactttagtagagtaagaaccgaagaactcctaaagagagaatactactaggtaaatctataggcggatatatagagatatattaaatcctatataatatattaaaccgcctaaacgctaaagtatcgtcctttcggtaagctcgaatctctaccgattctatcctagccctttaccgaattattaatagactttattatagggttaccttaatcgatctagaaaggaaggatagtagatactattctagtgattatagactatttctcgaaatagtgcctcttcttcctagtttcgataacgatagatatttcggaattagccgagcttttctattataatatcgaactaaggtttagcctactaaatagtattatatctaactagggatccgtttttataagtagattttagttaaaactatattatatatcctagataaaattaaggtactcgatagcgttttacccctagaccgatagttaaatagagaggataaattagacactcgaatactatcttcggtgttttattaacgagtaatagaaaatatagcctatactcctatatatagcggaatttatatataataatagagttaatataataattagaattttacccttctaggccttattaggctataatcctaatttctaaatacgcgctaaggatagtagcgtagagagggaggtaccggtagtagtatcgcgaattaagaagctttaagagctctacgaaaagctataggaagtatagcgaaaagccactaagatataggcgaattattataataaacgctattaaaagataatatttaaaaagaacgaccttatagccctctcgataaaaaacctataattaaaagaaggtataataaagaagctattactaagatagataggaccttttaggatctttaaatatatcggaaagtaagcgtatcgcctactactccctagctagtatatagcgatttataacgtatttcctatatctttactataattatagtattaatataaaggtaaatctaagcaattacctttactagagctagtagataacgataaataggaagtcgaggagataaaggataactagcggttcgaagataaactacactatctagtaaaatagtatagctagcccttagaatacaattaataggtacctaagagtgtaatagtgaatatactaaaagttatcgcgagatataaaaggtcctagagaaagtaaaattgatcagaagtagccgattatatactatattagtagcgaaacgatatatatataatcttaaatcgaccctatcttaccctatagctaacggagagatataaaagaaattcactaagtaaaataaaagaaatctaggtctaagacctctccgaaacgataccgataaactaccgctatacctatagatcgagggggaaactctctaagtgtaacttaaggaaaggactaaccgcgggccctagcttagaggagccgactaggtcttatatatcttagcggaaggtaacgacgctagtgtactaagacctagccgactcctccgcgacgcgtagataggggtaataggaaccctctatagtaagcttagcctagttagaagcaaaatctatagaaaggtcgctagagactactaaggaaaagcgagaaaacacctacctagtatatatatctttagttaactatataaattagtaataataaaacgaccctaaattataagcgaaacttacctaggatagcttagtaccggtaagcgaatatatatagcgatacgctttagtaaagctattaaaggacgcgactaaatatcgcacacttactataacgctatcgataaggtcctaagaaaagaggaacttagacgcgccttcctcgctagagctaaaacctccctcggtatttaactaaaattgttcgatctaagataaatatataagtaactccacttagtttctttcgatcccctcggggacctaggtaacgttagtctaaaacggttataaaataggatagtaacgtatataataatataccgttttatagggcttatagagactattataatattaataatttttgctattatatatagtagcgaagtatttcactaagaaaggctagagagctataggatctctttcgcgctaattataaatagagacgcgtaaataagtaaggcactaggttcggacctaaagaatagggttatataacttataaagagaattagggactaaaggtattataataatcttaatacaaaatataaccgaaataataccgttacgaaatagatatagaagtaataagataatagaaaggaagagaaagaaagataaagagcggaggataaataagtctagttacctatataataggataaattatcctaaaaaggaagctataatcgaggatataattaaagtagactcgcttctactatttctattaaacgggtaaaaaacttagagatactactaaatcggtaccttcctactatagaaactactatataatagttaagttaagctctatcgggtaatcctctattagaataggtatatcttaacctatctagaagttaatacggttagtaactatattagtaaaccgccgtttcgccgctatctaacttatatacctagggtctttaggataaaggccgataagacgatatcgtcccctagccgctattagcgcttataaatctatatagatagtatccgcccgatattcggtaataatacgtatataccttatacgcctagccttataaaagattagtaacgaattataaacgaaacggggtagtaactgttggggtggtcacgtgcttatcacgtgactcccgctctccaggacttcctcatgtttgtagatagcttccctctctctcttcttcttttctcctctccagagtccatccatttatttctctgagttgcatattccactgcgtagcttcttccttccatcaggttataaagccctttgctcgaggactccgagcatcatcaaaatcatcaattttcatcaagtttaactgagcgaatcagaattttcaaattttcattgtgggtcgcgcttcggcccgtcccgcaccccaccaaatcggattatcgaatctattatcatcaaggtagtgaaggttatcgatatcatcataggccgcatttctttattagagatttctcatcaagagagctctacattcacaaacagagatttttctatcgtgaaaactctacatttcttagcgagagttagcgaagacgcgtctctctacttctaaccggagatctttctatcgagaagactctacatttttcttagctagttaatataactaattccgaggataataacgccggtaagggcttatcacgctctctccccgcacctcgcacctaaacctaacctccttcctctatagcgaaacgagcgattcggacctagggtataaacctcccggaggagaaggaaatcaaattgaacaaaggtatcaagttattattagatagtagcaatcttgctagatagaaacgctagatcgagaacggacttagtatagtccgtatcgacaaagtggccaattacaaactaccccaaccgtaggagacagatcccgagtacaacatttaggaatactagtcaaaaatcgcctatagatagattgagagtctactagatcaagagattatcactattcttaaaggaggagtggaagcctttctacgttatatagatattataatacacgaagtggagactctcgttcgtagtgcagaaatcatagataatatcagacgtgaagtcattaagttttataagatccggagatcagatttctctagcgctaatacctatattacggcgtatcagacgtagtataactaactaggcctatataaggtagagccgcaccctttcggtgcaatatttattatactttataatctcgaaggagaactagattcggtgaagttcacctactagacaataaaggatactattctagagagcgttataaaggacgactttaatagcttatataaaaagctaattgtagaagctcgtgatatacctactttattaagcgcctccactatagcaaatatagcgcggaagatagagaacccgcgcggtagacaaggacgcggtcgtagcggacgcggccgcggcggcggatataatactttatcggacactaagatagatataaagatagagggagagttattctttaaaaacggtctagtaaaaggtaagactatcgactagtgggtagagcaataaagaaactaataaccgtagtacgtcaatagctacaaatatccccactatagtatcgaaggttatctagcaaagatatactaccaccttatagaagacctcattttcgaaaggtggaaaccggtaaagaatgtctagtgttatagtattgcaaagcggttagcaaacaataagaagaacgaaggtaaggctagtgtagctcgggtaaactccgcacgctctgtagataagatatagatactagatagtggtacttctaaaaccattactagtcactataaagatttttacaaatatactaaatataaagctagagaaacgctatatacctatactaatactaatagtaatattcaattcgcaatagtatatagtaaggccctagtctagatcaagacttcgactaggaaagtgagaacaatccttatctctacctactataacctattaactaaagatagactactttctataaatactttagaagtagattataggatttattataacccgatcacgttaaagcttatacgtataaaccgggaggaagtcggcctagtgaagaaggttagcggacttctatagattaacggcccgcttttttatagtgtaaagagcgaagccgaagatataaagaaagagaatataaaaatagagatttcaactaaggtctaaaagacgcatttttacgagcctaattctagctctaagtctaacgataaagataaagaccttaatagagttagtaaggtagtctctacgtacgaaatatatagacgtctaggatatatcggtaaaccgtatattaaagcttctttagcggatactattcttcttaataaggataactaggttaagctttacgactttgattgtgaagtatattagcttaggaaagcgaagaagcggatctcgagagacaaataacgatatattaaaaagcctagtatgaaattttatactaatacctagactataaatccccccggacccggtagagagaaatattaggttcctattatagataactatacccgatataccgagggcccctattttcgcactaaagataagattgcggaatatataatcaaattttataagcgatagaagcttctccgcggtagatacctagctatctagcgtattaacggaggaagcgaattccacaagttctagatatagggggagagtgagggaatgatttttaaactcacacccgcgtacacacctaagcctaatagtgtagcggagcgtataggaggctatattaaccaaatatagaggacgataaatatagatactaagcttctagactctctctagccttttcgtgtaaataccgctatttatatttataaccgcctagtaaaccctaaaataggcaaaaccctaattattacctagtagcaagatctcggtataggagaaacgaaggtcaatctaaagtaccttcgtctatagggagtaattgtttttatctacattctaagagagacttatatttagtcagagaagttaggagcacgagtattctagggatatctaattagttataaaggagaaaacggctatatctttaaggtatagaatcctattataaaggaaattatacgctcctaggatatcactttcctagacaaactagataagaaaggtctagataacaataagaaggggggtctagcaccggctaaaaagctagcactaaaagaccctaattcggataataacgacaccggagcactttacgaataaggaggaccggtaataacctagattaaaaagggaaaacagctatttaaaagacctaggattcaactaaggctagttccgtaggttattattactaataggaagccagaacctactatttaaggtctaataaagctaataattcagtaaaagcaacccttagtgggaccgaacacactaggaagagtatagactataccactaacacctaaagtgtcaactaggatctaggaagtcgaggatatatctccaattcgatagcctatcttctaaaagctagtaaagagacagccgatataataggctaaatagcggtctaaatagtaggctacaccgcacaatacactataggctatataacgtcctacgctctaaccctaagctcgggaattaatcagaaagcatatagattagcttagtgtagaagtgttagttcttcctctaccactaccttagcctagaaagtaagctacaaagcctctagtactagaagtgatcccggaatcccctattcactagtcgatcgagcgtaacgatagtgaggatacttataagacctttatatataaaccaattaaataggcagtttctctataagaagagagataggtagtctcttagtaggaagagagataggtattttcttaccgagaggaagagacactaatttagcgagatctcacaccgctagtagtagttattaaatcactaacactatatttactaggtgcatttagagaggatataccgtagtaggagactctaaaactagttctacacacttagcaagagatttcttataaagctctctcttatagagaggaagagccttcttagtccactttttatcaataataggaagagatttcttaggagcctttttaataataagaagaggagattttatagctataagaagagatttcttataatatttctacaatcgagaccgattagagcatgatttaataggatcgttagccgtccgttatcacaattagtagcgacgagacaattccgtagtttattccccgccgtttaagccgcacgagacgctcaccggagcgctatagcttccccgagaaccccctacgtcccccgagaccgaatcctctaccgaaaccgaagacgaagataatacgcgtgagaccggacgttccgtagggtaataatagtgctagcgagggatctagatagggataggataagtaggatatatagagaggaaggctagtagtgtcgaaggttcttactaagtaaagcactccctttatttataatagtaagccgctttatattaaagacgtcgatatcccttagtcctataagtaagctctaaagtctaaatttatagacagatagcaagctactatagagagttagattgataatctctatataaaagacactttcgatattattcgaagaccgctaggaatcactccgcttctaagctaataggtgtataatcttaaagtcactaaagacaataaggtatatagttttaaagtaagataggtagtgtacgggaacttctagataaagaaggaagactctattttctacgcacctatcgtctaaaacacacttattaagatcattttcactattattgcgtaacggaattacaaatagaagcaatttaatatagttatagtatatctaaatatatcacgagataatcaggaaatagtctatatatttcaaccccttagtttcgagtactataaaccggatattagaatcaaaggctaggtttatcaattaaaacaggctctatacggacttcgtgatttagcagctttatagaataaagagctagatactagattaaataagattgatttttacgcactcgacgacgatccttatatatatataaaaggttaaggcgtaatagtatagtttttactagtttatatagatgatttcattactaccgcactaacagatacggaagtgtagcagatttaccactagacgaaggagtagttcgaaatcaaagatataggagagccttcacgctttctcggtagcgctatttctcgggactatagtaagaagactattacaatatcttagaaagcttataccctagaagcgctacgtcttatagaaatatagttatacacactaacccctatcccgctatcactaagccggaaataggaggttgacaataataccccggagacccgtttacacgataaagattatatattatatagatctcttattaggagactaaactagctcactataaagataagaccggatatcaagtttacggtcataaaattataacaccgctctatagctcctaccactaataatatataagctatccgataggtctacagatacctaaaagggacaatagagctttatataacgctcggaagaatctaggatacgactttctttacatatatagacgccttatatagagactagcctaatacgaagtctatagagggggctatctagttcttcggcggtgtaccaattaggtggtattcaaggaagtagacaattatagcactatcttcgacagtagcggagtagtacgctcttaacagaccggcaagggatacccaatagctgataaaaatcgccaccgcattgaacctaccgaatatagcaaaacccatcgttatcttaacggataacatcaacacctagcttcttataggaaagcgctcttataaaaatagtataagatagcttgatatacgctagtttttcgttaaggacgcaatcttcagagagaagatcaatctgctacgtgttgatacgatacacaatatagcggacaggttcacaaaagctctcgataaggaagcacataacagatttgtgcacatactaggcctttagtggtctacatagaatttaccaatagagaaaggagtgtaatgatacgcaggaaaggcagtaaagactgcatgtttgaaaaaaaaaaaaaaaaagagaggtttttgtatagagagcaggaataggggtatctaggtcagtcctaaaggggggtgttggggtagtcacgtgcttatcacgtgactcccgctctccaggacttccttatgtttgtagatagcttccctctctctcttcttcttttctcctctccagagtccatccatttatttctctgagttgcatattccactgcgtagcttcttccttccatcagtaactcacctcttagaccttcttcgaccccgagagactataaaaggaataatataccctaagagaactatctaaagcggaggctaaattataactagcctccgagatattgagatatagttcttcgggctagtctataaagtctataaagaaaaagcttacctaatctaaaatatacactagatcccttatatctcgtaatatcctaataggaaactataataaattagtaccgtattatagctaaattataaggtccttactatttcgtaaatagcgtttttactattataatagttatagaggaccgagattctcttattaaacttatagtaagctaggttaaatagtgtatctatatctatcttatatatacttagtatataacggaaataacctaaatagaagaggtaacgaggccgaatgattttataagcgatattagtaagaggagctatagctatagtaccggatcactaccgatataggagagactcggggcgttaggggagatttatatctagcctagataaagaaaacgttccctttaacggcctcgggcttactataggaagagacacctatattagagagggtttacctagacaaagaagagcggtctcctttaatagtctccgtctaaccctaggtagggacacctacgttagaggagggggaataattgtaaaggataaaggtcctttcaatcataaaatagggaatgataggatatgcgtagtatatatcgtaatcaatgcgtgcggggttcgctaggtgatcggccctacttcttagcgcactaggattttcttttaatcctagggccccccgggggccccccctgatttgggacaagagttagtcttgtcatatagaggcaatacactttcattcctatccccgccattcgtatcttacccggttgacaggccttacacctgataactgtatatctttacagtattgtgcggtatagcaataaagaaatctctccgggcagttatcgagctattccttttatatataatctagtagtggggtaaagaggctagagggattagtgtatcgtgctttgaaattgttctattgtcgatccttttctttaaatatgatagtatatataacacggttctacctatagagcatcttcttccacctcttctcggcttttttacggtcttcttaggctttagcgggagtaaggcgtgtacgggggtcctctctaagagcttctcgatagtctcgacgtgcttgcgtaacttgattagcgagaagagggcgtgctttctttaaaatatttatattaatatactaaatataaatcatgttttttatatcgggaaaaacagtctcaattgcagttattaacgctcgctctttattagttaggattgtacgcgggggtggaaggctaagagattcgtaggcttcggtaaggtaggtaagtataatctagtagtaaagtattaattagtattaggatcatatagtattaggattatataggttatacctacctcgtatgaatcatcctttttatctcgtataaaggcaaaacctaggtggaatgtcgatctagtagtagcgaagcccacgatatctagtaaaggaagaccgtaccggttagtcttatacgtgtagtctatagagatcacctaagggttcttctaaagtattataatacttgatttatatatataaaataaagcagacgtataggattgtttatctagcttatatttgaagatctagctactatccttcggaagttctattaataacgcttaaaggggcgtacggccggtaagaaagacctcgtttagcttccgacgagcgttgtaaatatcctagggaactaggatagtattaggattggtcttatatagcttagttaagatctgcttggttgtatagccttgggaaagcgtatgcgctagctcgctcttcttataggtaagatcaagagctcgctagatcggataggttaatgctagtgagggtttatggttataggtcgggttctcgattgttagatgctaaaggcctgtcttaagatatagacgaagagttatcttgaatggatatctaagccttagtgtagtagtcctccggcgtttatatagcttatctagattaagattatcgttatgaagtggatggctatagttataaatgagtgggatagtcttctttacccctttctttgtaaactttgaacggatacttataaccgtatagctatagggcttcgtaaaggtatttactacttccctcgcttccttatatgtactatattaccggtttagcggggggagcgggaatgtaaagcttggcgtagactcggtgactaggcctggctcgggattagtgcttggcactgcgggtagagactcggggacgatctctggctcggaatccgaggatagtaggtattcaatgtattcaaggcctagcgaggctatattgaggatgaaaactgataaaaatagatgaaattagagggatttagacgaaaatgaatgttaaaaatgaggtggaagaaggtaggttaatatatgtaaaccagaattagagtatcaatttgttttgatcctatgtatagagtgctatatgataaaagtgacttaattttgttaggggtttacatataaattgtaggtacctgctatatcactacaattgtatggggactttgacacgaaggcggtgtaaaaattggaaggcggtgtggagcgcggtagacaggtgcagaggtcgaggcaggtgtattaccagattaggaaggcggtactgaaaaatcaggcattttcaggcaggggggggtcaagtaaagatggggggggggggggggtcatattaccaatcccctattgatataccgtgacctgaaatatcgcatttagtatggtgttttggggctaaccggttgatcgtgttaaccggttggccgtggattacgttacttatattatctacccaggtatccatggatgtattgaacttcattagattcagtactcgaggaagcaagtctatcgaaaccgtcccacacagcgtaatctatattccaaaaaaaaaagttctaaaaaaaaagcacagaagttaagatgtgtggatagacacatcctgagctaaagcaatggttcactcgcatgtctggaaagtgaaagggggtggtaacgccaagaagttggtgtttaaatcagccaatcatattagattgcgaatcgaccatctttacccggaaaatatatcatcccccgacctgcggcccgacccaccaagtactgtcggcctgacctgcgtccttgccgcgataacaaactacctcacttagaaacggatttcatccccatactgttgctttcagctccataccgattcgtgacaaatagtgcaaatgctggaccacgactgtgctcatacgccttagcagcgctgcgcgatcatgttaactccctcagggcctttccccgagcggtcgccgtcgccgtcgccaagggtggaagactcatttccgtggtcctcgcgaagtcctcaactgccagcgagaagggtttcgataagccccacgacaagccccagctcggttggtgggtcgctggatagcgcggatcacaggcgaaggactgcggtagcagagtcgggtcagaatggtaggcaagcacatagacacaatacatgaagatatattgacgattatggaagcgatatctacactcctgcagacctcgcttctcccttagaccgcgatccattcgacttcacagaaaccgcccacctcccgagacatacctcctgtcattctctccactgtcccccatgtggaaccatcggcctttaaagactacctcagtgaggttggaagcctatttgatactttccaacgcacgaatccagagtccaaagagatgtttcgtcaagacagctccagtaccaaaggcgacgaagctgcaccgtggggaaggcggaagacgagcgtttcgaagcgcggccagcttgcgcctacaccgctgtcaacaattccttctgtgtatttcgatgaaaactttcgcctcgagaatccgcgcgttttcgatgttgtcagtgagcataccgaggttgtaaggcagccaatgtccaccatcggaggtgataacattgctgcaaatagcgacccgcagcctactaggaagacgcttgctacctataccatcttgcaagagaagctatcgtggtacatggacactgtagagattcatttggtattttcaatttcgcaagcgtcaccctcttttttcgccgcgctcggctcccttcgtgaactccaggccgaggcaaccgactctgtcgcaaagatccagaatctgaggaatgacctcgcgcatttggacaaagagatggttgtgcgcggtttggaaatcatcagattgaagcgaagacgggtcaatctgacaaagctgggtgaggctaccaaacaacttcaatgtgttctcagcggcgcgagccattgcgaggaactcgtaaactctgggcagctggagatggcaatgcaacacgtctcatacgtcgaacagcttgcatccggaacgctggatccgaaaattggcggcgaattgcattggttgctgccgaaccaattcatccggcttactgatctacgtcgactgcacgctctcggaggactgctgcgagacatcgaccagcttcacctgcggattggaaaaggctatgaagcccgattgctggacgtccttctgggcgacctgcgccgacatgtgtccgacgcaccacccagaaacactctggcgcgctggacaaaaagcgcacagggcgcgacagatgcatcttcattgacttgtctgatgatggcagaaaagctgcgcgaagaactcactcctgtcctgcagggccttggccactcgcactatctagctgcagcaagtaccacgtttcgtgaagctcttatccgagaaatgaagtctcttatccgccagcacttgccgagctctactgacgaagaaagtgaatcgtctgcatccacgtgggcaggtggtcgacggccgaccaagcaggaaatgtcgagcgttctgtctcgcaacttgcgtgctctcagtcccgatgacgccgaggcgttcttcgtcaaggtctactgcgggataggcgaagcattacggaggcttagtgtgcaggtcaaggttctcctcgatatcacaagcggcatgaagacttcaaacaacgtacttacttccgtccaaagcccgggaagcaagggcaacccgacttcccgttcgcctagcctttcgatgggatgtaatttgcaggaagagataactcatgcccttgacatgtcgagcctcctcgaacaggcagtggacaaggcacaatcagagatcacaaaggtgctgcgagtcagaaccgagcaaactgttcaccttggattgacagatttcctaagctacttcacgctgaatcgcttgtttgtcaatgaatgcgaggcagtctctggtcactctggcgagacccttaaaggtgtcgtgaacaaccaaatccacacctttatcccgattctgcacgaagtggaaaagcaaaagctggtgcaaaagatagagtctgagaagtgggaacgtatcgacttcaagccgcaggacgcattgacccttgcgcacgtcgtccagtccatgaccactgatccaccggcatggctcagttacacggatctcagtgccgcagtcctggaaacaggcgaactaaagttgcagaaaacccacacccctgcagaaccgacgactgctcctaagcaaaataagaaagaaccggcactagcggtcatcgagggtgagaagttcacgcttgtcgattcggcagtactagcgcttcgcggtatagaacaatacacaatcctcttggcatcggtccccggcatggtcaacgacatctcgacgctcctaatcgactacctcaaactgtacaactctcgcgcacaacagcttattctcggtgcaggcgctaagataacagctgggctgaccaatatcaataccaagcaccttgcccttgcctcgcagtcgctgtccttcttcattgctctaataccctacgtgcgcgaatgtgttcgtcgtcgaccgtccatgacagggtccggcatagcacaatatgaccggttgaaacgcctgttccaagaccaccagtccactatccacgacaagctcgtcgacataatgagttctcgcgcgaccgtttgcatcagagagatgaataagatcaagtgggacgacgaagatgaggtgcggaggaacgtcagcctatatatggagacgctcacgaaagaggcgctcacgctacaacgagtgctgagcaagtacctatccgcattgaacgtgagcatgattgtcggacaggtcttaacgaactataaggagcaatggagcaaagctttcgaaggtgcggcgatacagaccgaggccggaaaagcgaggtgagtatctttctcgagaacatgtcgtttctggctaaccaatgtgtaggcttctgcgagatgcggagcttctcgaatcaaagctcggcaagattgacggcggacaagagctcggcgtgcacataatcaatattgtcaaggcgaagaaggtcgcatcccagccataggcaagcacgagagagggcaggcccgcgcaagagcgaaacgccatatgcctgaaaacgcatatgtatattaaattagattacttaccaccgactttcctctttgcttgatctggcattcatctctcaagtttggcataaagactcgacgcattccgtcctgataggccacgcctccgtgtcagacagcgaacccatatcatgttgactttggattgtatcattctactacctgctgaatactgatttcaacaatcgatggacgaaaccatcgcagagccacgacgtcagcttgaagaggagagacgggcgcgagaagaggcagagcgcctccagggagaggcaggacgacgacttcaaccaaataccctgcttcgccttcttgatcgctgccatgaatctctgtctcaagcgatccgtccgagtcgcgacggatgttaccctcacgactcagggtgacgcgaccgacccagtgaaccgactttaccctaggcgcatagtcccttagcctaacttcccctagctcccaacagcaagtctagagcaaacttgatcgcaccgctacatttacctcgcgcccgctattcccttccgatactcaaatcgattacgtcgccacgaatatctagaacagcccaatctatttagagacgtcgctttggaactttgagcgagatattgtagataacttcgtcgaaaaggttattaatgctttacgagacaatagagctcttcgctataagtttaggatccaaggccgagttactttctacgaacgcgcgaaccaatcggaaactttgtagagaaccatggtgctttgctctacatgtccagaatagatcctaagctgccttagccgaataagtattgatgctgctactgctaattttggtcaaaatttgtcgacttgaaatgttttggccatgaccctggcactagttctaatacatttccgtcttccatcattggaggccggagcaagggccagtttgtaagcaacgggtgtggctgctgggttaaattgagcgtcgtgaacgaccaatgtctcaacaatccatcacttgcagggtaattattgaggcagtcagcacctactcagcagtataacatcatcataggttattcaggctgtttccatggcgcctctgaaaagtatgagaagagtcataagagcgacactaccccgatttcatcgcatgctcctttccccgtcgagaacctccaaacctctccatcacagtaagctcgtcaagataaatttgcttgatttttactgaatttgtctctctaaggtacaatcaactcagatcaacgtggcgacacactcttttcttatacctctgggcgctggctatgggacgaggcagcccagcttcgtaaacggtaccagcccttcaatgtcgaggaactcaaacaaacagcggccagatcagttaatgctgaattctgcgtcaaaatagtcaaattacccgaaggctcatacaacaaagcctttctattgacaatggataatgacgtccaggtcattgcgaaaatccccaatccttacatccctcagaaatccgttaccgccagtgaagttgccacgcttgactttcttcgtaacgagctaggtatacctgtcccgcgagtccttgcttggagcagcaagaaagaccagcctgtgggagtcgaatacatcatcatggaaaaagctgctggcaatgaattgagcaaaagttggcccactatggatatatcggataaggtggacattgtgtctcagttggccaatattcaagccaaaatagccgccgtcgatttcggttgttatggaagcttgttctataaaggagatgttgagggtggcattgatgtccctggaatagctgatcagttttgcatcggtccgagctgtgatatacgattttgggaggaggagaggagattcatgaacgcttttaggggcccttgtaagccaacaccgaatcatacttttggggtccaactaataaccgagcaaacttagggtcgtcgtctggggcatatgcgatagagatcgccaggcgagagaaagaatggatcacccggtttgcaaatcctcgtcatccggcagaccccctgagacagtcagatagccaagagtctcctgattgtcacattaaacttctcgacaagtatctgggagttgtgcctcatttgataccatcacatccaggtcaaaatcggtctgtgctttggcactctgatttacactttgggaatatatttgtaaaggaaaatcagattgtcagcatcattgattggcagggctgctcaggtcttcccgtttttcaggcctgcaggataccgaaattcctgaaaattcatgggcccttgcttttcgaccttccgtcagccacgggcctcacgccaaaagaaaaagaggaaaatttacggagataccagcttacacaacttcagaggctctatatttccaaattctgcgaaattgacaatgacgtcttctctgctctgtcattccctcaagctttaacgcggcagcagctcatccatttttcggggtacacatgggatgacgatggattgtttttgtttcgagagatgatgattcgaacatggcgcgaatggatggaattaactggccagccacagtccgcttgtcctgtgacattcggcgcggatgagcttgcgtctcatgttgccgaagggaagagctgggaagatcgcagggagctcttcgatacccttggggtccccattgacggctgggtacatcttgaagatttcgaggcaaaagtggaaacaatgcgtaatctggtgagttcggtcatcgacgctacggatgacaaggatggcgcaaaagacgcactaagggcttggaaactgtcggagtccggacctgccagcctatcgggtagtctgatggatatctagagggcgtttcctgaagtgcatccctgtaggatatcgatgacaggacggtgtattagggcgctaggccaggaacggcaaaactaacccagaggaaattcacaggtgccaacattacaatgcaaatatcccctataagattgccgagcacctaatacgctcaggctataacgaggaggtggtgtaagtgttgccacttaactaagtcagtgaacagttttctgtcttctcttaggtttaggatcaatggtgctctggagaattagtcggttgatccgaatgcgcataagaacgagaccgctcgcactacttccctcaagggaaatttgctggcgacgatgggcaagatgcaggaagcatttattgcctttaaagtttcttgtcgcttgaggaaggatatcaccaaggaggatcgagatttgaagagcttgaccacgaaggacttcgacgacatcgttgctttttgggcccgctaatgaatcctcctcctactcctccttttctttttcttcttgtttttatacgtgggaacagattcctggcgttctataagcaccaaattgaattggaaccgttccattaatgtattcgaaatgccacatcgagaccgtacttcccgtaatcaaagtgttctagactaggtatactctcagcccagccatcatcaatctctccaagttgccagtcgtctccgaccttgaatcttcccgacctcccagccaggatatccttgtgcatcggttggtactcatacgccacgtctggatgtggaacccaaacgactctcatcccagcgcgtcttccagcctctacaccagcgacgctatcttcgaagaccagacattcactaggtaggatagggctttccccaggctcaatccctgagttcaacgactccaacgcgagcaaataaatatcgggcgctggcttccctcgaccttttttcactcgtgggtcatcacctaggacccttctatccgaccggaagaagctcaacagttgtttcgattctagtcccgaagtcttcaactcataactacgggtcttggtgctagaagccaaagctagctggatcttatccccagacgaagcgttccgtgcacagctcagatttgacagaatcttctccgccccaggtaggggcctgcaatctggaaagagcagtcgcatgccttcgcttgattcgcgggcgaattgctcgcgagagatgggcaacttggcccaattgtggaatatgtcgccgtttgttgagtccgcgacacccattagctgggcttgaatcgacctagtcaaaggaggccttccgtacttttgtaacaattgattcgtggatagactgattatgtcttcggagttgatgagaaggccgtccatgtcgaaaatacaggcacgcactgcggggaagctggtgtttgttagctttgggttttacagaagtcgtatgttggcattcgacaatgctttcgctagatgttgcatttacatagatgtctatgttgggggactcactctgttttagggggagccatgagcaccgagcgaaggcaaactttggtcccgattggtggcagtgggagtgatatgagggatggaggtatgggctggggttggatcaggatcgcaaagcctaactctccttcgcgccaatctctaaagggtttggggcgcagccctggaggggttaaacacctatgtattatttaggtatcttttgtatgccattcccatacaaaaggtatatagtctccgcgatgatacttacattagcatgtggatacggactaatatttaaggatcaggaggtggtaattctaaggctttgataaagtttattgcatggttgatatactctatgataattaaagggcctaaaccaagcggactcttgtatttggtgccctaatgtagaatgaagggcaccagaatagaactatcggcctggatggaccctatcgctgcagcaccgttgtgaaccttttctttgaggaacattgccgttccaggcttgggtagccgggaatgtaagaggtctttggcgccgtaacatatacaagtccaatgcacattggccaccagctctattggatttttattctttcttttttgtttcaattgctgttttgaacataaaacggaatgctgggaatggtttacctttatcaaaattccccgttaggttatgagtggctaacatgaatctgcgtttgattgagatcggcaggtgtatggcatacagtgaagaattcgtcgttcgtaccatttacttattctccatgtgaaactatttttaggcttcgtatcatctaccacatgctggcttgtgacttgagatttcttgtctattcatggtctgagacaagaaatagaatgaccaattccaagctgtgattctaccggccggcaattggaaccagcaatatcgtagtttatcacatcgctatacgcactgacagacgccaataaagcagagtttcgagtggtgaattatgtctcacgtaaaagccaatggaattcgagttgatccagtcgctcgtgttcgccctcgtattcatatgacgtcgggagaacatcgaccgcggtgaagatggaaagtctggggtagtggcgaataacctgagcttgagacatcattatcaaacgctgtcaatggattcgtatcaggtcatctggtccgggagttccaagggttgttcgaaagttgatgctttaggcattcacatgtcttagtgcggtgtatatatagacaccgatggaggtgcttcattccatatctctgagatatttggatcaatcgatcacgatttatcctcacgtaaccaagagctagatatcgatatcacgaagatgcttctctataaggctcttgctcttgtcctcgcccacctcaccctgagccgtaagtatttaaccaacacctacatcaaacccagtcgtattaactacatctccctcccaaacagaagcagcagcttgtccagcaggaggatgtggcagtgctgatgcctgtgtcctcaccgaaacatgcacaacagcaacctttgtctcgccctcgacaacgactatcacaacctgtgtcccaacacccacctgcgcgggggtctactgtaagaaccgggagatcacatctaagcacaacattgaaagtaccgctctctaactaatggtagcatcctgtgaattcggcaacccgaacagccgatgctgctcgggctactgcgctgcgaacaagtgtcgatcgacggatgatgattggccactttgtagcgaggataatggtccctgcgttgtcgatgaacactgctgttatggaaatacctgcgtaaatgggatctgtagccggacttgatacgggatcgttatatatcagaatgcctaggcgagtgtagtcggaattattgataatcaattaatcaatgactttagtttttacactaaaggccagacaatttattttgggctgcaggacatttgccatgaaaacgtaatgtagacatagatttgcctagacaagcatagccacatacgtcctcacatcgccaacacttgctcagccctctcagtaaatgccttcatagcagcccgccacaactccggcccaacactaatcctcgcaacgcccaactcccgaatctccttcacccccagaaagccctctctcaaagtcattttcacgttaaccatgccacctaaggcatcaaccaacttcctcacctccgcactggaaacacccctcccactaggcccaccccaaacaaaaaccgtagtagcaccagcattcaaaaacgccctcccacgctcgatagcctgctcaacagtcccattctccgtcagcaatacatcagtcctagcattaaccacaaaatcaggaacccccgcctccctagccgcctgaacagcaacccctacccgcgccgctgcctcatccaccgaccacagcacaccagtcgcgtccatatcttcgagattacaccccacagcgcctagcgcgatgacctgtctaatggtatctgctagttccgagacatcgccgtgaccatcttgcacatcgacggttaatggtttggtcgggttcgtggcgcgaacggaggcggcgattgcggctatcgcggtgaggttttgggctttcgtcagcgcgttatcgtccacgccgatcgttgcagcgatcgcgtaggacgctgttgcgatggccggtgctgttggtaatgcggcgattatcgaggctgttgcggcgtcgtagacatttgttaggattagggggttgccgggttggtggagggcgcggaagtgtttggcgatgtcgttttgggatggcattttggattatttttggatgattgggatattggatattagagatttggggattttattctagatacatagacggagtacttggtgttatctactttgaacatggggactgtttgagtcattgaatacgaggtactccgtagagaatgaggattttcggaaccgacggttctgcacggatctacgcagatcggaggagcaaggcagacaatggggactatttccccttgtctcagactagacagctggagaataagctgaatggcgcaagggagttcccctctccggatgaattccctccacttgctcaagttgaggagaccatgcaggtcattacgctgctctacagctgcttatggattctccatgtaactcgatctcattcaggtttgccactgtgtgtatatgtattcgattttggatggggatcgacgtgaattgaccggtccaacacccaataactatggggcgaaactgcaaaggaacagaaagagtaaaataataaaaaagaaataccaaaaaaaagaagggtgtaatacaacatacaccccggagcctgatggcttgctctccattgctccattgggatgcataaatggaccttccatgcagctgtgaaaccgaagatccaataagccaaaggaactgcccaggtgcttcaggtggaatttatcctttaccctggagatatcatagggacaatgcacagagacatcctatttgaacttcttttactccatacaatcgaactaccattcctcccaaatggtccaaaacaataaaggctacatatgtaatcaaaataggagcccgatgacatgtggtacgaggaattggccccgttccctagcctatcgaaaggagtaagagtccgtagtaagtccactagtccgatgtagggcgaaacattgaacggtaacacacctgggacctttcgggttggatatccgtgcctgggtgcatatgaacgaggggcaaagctgtggcattcctcatgagtacccgggtgattgtcattgggggagagagggagagagagagactggaatgttgggtttatttcgtttcagatgttctttttataaaccctttataaaacctttattagaccaagacataggacataggacataggacataggtactatgtacttcttgtactcctatccgtacggagttcttccacttcaaatacaatttaatatacatttaatatagatcaaagtcaaacaaaaacccgaccgcacccgcttcggtaaactggacactcgggaagccccgttgctgatggagactctttttttcttttctcctcacggtaatttggtattggtattggtattgtatttgtaatctgagcctagattctgcggttcgaaggttccaatgttgtgtgtacatggggggtgtacggcattacaatatcttaattatctttcggggaagcaaaaaacaagaaaacaaggaaggggaaaaaagaaagaaaaagaaaagtgacttgaagggaagtaactttacaaatagcacttgggataggacaaaggccctgagaccagaatgactttccgatacggggacgatactccaagtccacttcagggacgagagaaagtctatacatatatggggagagatgaataggagacaatagaacaatagatcatttaccattatacatttcgtagaatttctattcaattatctgttcaatattttattataagaaataccagaattataaagaacattggatgtatctatgttctatgtacattataacaatacaatgaaattactataattaattaattaataaaaaaaaggaaaaacccccatcgggaatcccctgtaattttacaaggaatcgccgtcagctctccccactctacggcttcgccttgctctctttctgcttctctttctgctcctcttctctcttctctgtaccatttgcatcttacattctgcattgcttcctctgtatcccttatttctaacgatcttatggcgtatggttttacctcactccctcgtgcagttggccgcctgacctgcagccctcacgctgccatccgaccctgctcacatcctcgaatccctcgctcttcctcccgaccttgacctctcctcaactcccataatgtcgaccggactgaatattcctcagaccgggctgtctctccacctcggagatcagtccggtgatccttccgttaagccaaatcagatcatgcggttgaatttggtgcagagcaccctcgatgatctgattcagagcctacggaaggatcaaccggctcgagtccggctgggaaaacacccttcacttcactatgggggaaagtctcaaacgttccatgcctaccccgaaacccaccgatctgagatctaccatagctcatccgataaagagtcactgtatttcacaggggttttaagccatagtctcgaggttgaaaaggctaaaaatgctaccgccgccaccgatcaggcgctggcagagttggaggagaaattaaatgctcacgagagagggaaggagtcgaagaagactcacctaatctcacatccagatgagctgaaggctctccgaggcagcaagtcaggctacaaaggtcccaccaccaaagtcgaacttgagaaagatcgtttcctcaaaactgctgccaatcgttctctcactgcaagtccgatcttgggtgcccccaagtctccctctctcgcaatgactccaacctctgctccaatgatggagaacaaagaccgtgcgaggctcgaagccctcaaggttcccttcattcaccttctcgccgttcgcgccgtatcggccaagttccttgcccgccaaacccgctccaccatcgaagactgcaccgccctcggcgagaaattcggcgttttgaaccgaatcaaccccgagaaatatgatctcaaggacaaagtctacaaggatcttgatttgtttggcttcaattacacggaggaggaccgaaaggaagccattgagaattctatctctgcctttgatcgcatgcgcatctctcgatccgacaaactttggcaaacacttcttcccaagtctgaacggggcaagggaaagtgcctgtcgcgtttgaaccttcgcactggcccgccccagaaacctgccccactcgccaaatccaacggagaggactcgggcaaggacaatgagaccgaccgcgccacaaagggttccaagactacttcgaccgcgcaaaaggctcgcgacaaggacccgaccaagcgacccaccaaaaccaagaataccaacagcaccctcaccggacgggttacgaagaagactggtgggaaggcaccggtcaaagtggacagcaagatcaagtctgcggaattcgtccacagttcggacgatgatgacgataccgacatgcctgatatcccccctgctgcccccactcctactcccgcgcctgcagccaagccgcaaccgaaggaacacaagcggactccatccaattcgaatcccccagcaccgaaaatcaaggcaccggccaagcctcgcaccactgagacagttcctgctcctgctcccaaggccaaacctgaggcatcgaagcctaagcttgaaccatccaaaccggtcagcaaggtcacgtcttccaagcgtcctccctctcgaccctctacttcaccgcagaagccgtctccactcggctcctcacctcctgccaatgtttccgatgctaccagtagcaaccgcagccgggctgacagccagaaccaatcctctggttcatcctcgtcttcgcctctcatctcccagctagccaaacccgccaaggtgcggcgtgcagcccctgctgctaccaaatctggcaaaagtactccccagcccaacggtattacgaaggccaccccggctaccaccaactcattgaagcgcaaggccgagcccgattcattatccgttccccaggcaggacgtcctagtgcaaacttggaagccaagcggcgtcgagcggtcagctcctctagcggtggcagcaccggcagcgcgtctccaccaatgagctacgagattctgagacagcagctgcgggagaagtctcagaaattcaagaacttttacaccaaataccgcaacttgcatgactcccttgcagcacttcccaacccgccccaggtggaccttgacaagctgcaaaagcagcacattcatctgcaacgcatgaagaaggaaatctgggaggaagatcggcagcttcgcgatggccttcattcttaatttaatctcgttattctcttttatcacatctgcatggtgaccgtgtcgagtgccgaatcaaccaacagcgcggcgtttgcatgtatatcggtcatattatccttaccatagcaattcatatccttatgattcaattttcttggttcgtagagtagcacttgctttcggatagtcaggccaccaatcaacacaaacaaataagtcgagaatcacattgacttctggaatcaatgaaatgaatctcacaagtcaatgaaatatcaataaaaactcagtctcatttcatttcatagtcagtaaacaatggaaccggtttccggtcgatcttcacttttaccccagatcaactaaaacgccatcggacagctgctagtcccaataaggtatggtggccctgtcttgtagggcggtgtaacacgtggcaatgtcacgggattggcgattcaatatacacgtgactgtaacagtagacgtcatttggtcgctcaataaactattccgagttaggcttagcgtcgaggccattcgaacttgctggttcggagcatcatatatagcgatcgatacacccacggccagttatttcttctatgttgcaaagtgccagcagataaacactaaaagggagatactcaagcgccaattttaggctcctttgacaatgactcccccggcccgaggacgggggactaaccagcgcagcccaactgtcttggtgggatcgactatcaaatcaccatgcgaatcaatatgaactgacgcatatcttcaacacaggttacagattcccgagaccagcaacagccccaaacgccccgacgccgccgctcgcccgcaactcgattcatcaccgtcgacaatgtcctccaatatgcctccgacgttccttcaatgcagcagcgcgggccaccagcaacctcacggtcacgccgtcttgcctctgcagctggaggcttaataaccagctcgggcagcagcagttcaagcgcagtggcagggtccggcggaacgatgggccgactcgccgcgcaaccgcggctcccgcctcgaacgacaaaagtcagtgagaagctggttcttcttcctgatacgggagagctggaggagggttcacccgtagaagacgaagaagatgaatccgagggtgcggacctcgtggacgaggagcttgtcgcgcgtctggccaaggagaagaatgtcgacccggaaagaatcagacaccaattgcttgtgtcgaagcgacttgggggtgatttcggcatcgataatgatcttgcccctatgctggccgaggaagaaatcttgaagaaacgtcgtgttgcgcctgagcgcgcgaagagttatgctgagcggttgccgaaggcgcggcggacggagaagcttgcgcgtgttacggcgtactgtacggctcaggcgtataagatgggatctctcgctgcttttgttaaggagcagcatggtgggcggacgaagctttatgatgattgtctttacacggcatatcatcttcctcttttgcctggccatgaggggtatcgtctgcggagtagccctgtgttgaaatatcccggtgggaagtcgctgttggacgaggagattgaacgaaatgaacttcgtgactatcatgatgaatacatgctggagacagaggagcattcagttggtggacacaatcgtccagaggacgagcaccattatgaagcatcgccgcgacagcatgagggccatgatcaccgggaagaaaatcgcgaggaattccttagtcgcatcgctgaggaagttcatggccacctccccaatgaccacgaccatgagcatgctgccagctctggtgaaagtgtcgatgggctgcagcgtatcccaccactcccgcaaccagacagcaatgcaggaactcggcaatcttcgcctgaacctgcactccgtcgccgaaggcacagcacagacgacagccacgctttgattcgagaccgttcccctctaccggcccctgcgccttcgtcttcaacaccgcaagccccggctcggacgttatacaatgttgctgagatgttcgttttcagttacggtgtcgttgtcttctggaacttcaccgagcggcaggagaaagacctgctggcagatctggcctttgcgacgtcgtctgcgactggtatccctattccgctggcaacgatgccccttgacgaggaagactttgagacagaggagttccacttcgagtattcgaccgagatctcgcgtccccgagtctacaacgatatgatcactcttcgcagtggcgaccacatgatcaagctcgctattagccatgctatctcacagagcactaaactgtgtttctttgaggaagtcatggcccggcagatggcggacgctaaggacgtccccagacgtcttgcggttacaggccaattgggaatgaagcgcgaagaggtcttccggatattgggtcggttgtttaagagtcgtgttgaggtcaacctttgtgagttcccaacccaccctacaggccatcttgcatgctatactaccgaggagagacgttgttccatactaacatttcccaccagcatctaatatgctcgatgtccccaacttcttctgggagagcgaaccaaccctttacccactctacatcgccgtgcgcgagtatttggagatcaaaccacgaattcaggttctcaacgagagatgtcgcgtattcctcgatcttgcagagatattgtccgactcgatcgccgacaaccgcacctcccgtatgtttggccttctcgctcccctagcctcccagctaaccccattctagaccaaacctggatcatcattgtcctcatcatcatttcaatcatcgttacaatctccgaggtcttcctccgcttcgcccttctccatgcaagccagggtcccgctggtacacctgctagtatcttggcccgtgtcatgggccgatccgttaccccttctccgtcggagtggtactctgccgccaatgcgccgccaggctgcatctgtccctcactcggccctgcgggtgctggtttggatatgggcggaagcgaatggtgagattctaattcattttattaaaagctggatattatggcgtaatcggtgttaggggaggggtcgctggacaaattactttcaggttgcatatcgcctcgaaaatgacagattcttaatacattgactttctaaaattgattctctacctgccacttcgcatactacgctttggattgagcaaggcgtgtcgtctgtctatgcagcaataggaattttatatggccactatcgcaatatcttccctcatctttccccattcgctttcagaacatttccggacgtgcgagatactcgacactctcaaccatgtcttttcttctaagtcctgacagactggctttactcatctccaactgggcttcgatagccaacacgacagaagcctagtataacctcatcactggtacagcccgggagatgggcttgtcatctctattgactgggtcttcggacagttgctctagttacttcagcaacaggcacagaaaaggatcgcagaataccaaattccttgagttttactgcgtgggtaccagaaggacagccgattatggcttgctgaagtctcaaattcggtattagacgagctctgcggtgtctccaaacttattcacctgcacctagcaagccaagtactaacctattgcatgttaaggaatgggtgcgcgagtgatgtccctggctttggccgaagtcaaggcaacgagaatgcgtcccttctagccaatgtcgagatagggacggtgctcgacgcttccaggtcgctcgccgtttcacgcccgttgggacagatttgggagtggatgagagcacagcatacccaagtttatagagtactttgatactggaataagaaaataagtagaagatgaatccaaaatccccgttaagacggacagagccgaaccatgctaaatatgaaacagagacaccagatatcagtacaaaagggccgggatttcaaagagaaacccagcccggtttctctcgctgcccaacattcgttttatcgtatatccttcaaaatttcctttctagctgattttaaatttaaccggtaaccttgaagatggactcggcgagtctctgaacgttggcggaggtgataccagcgacggagatacggccatccttggtagcgtagacggagtgctagagaagaatgttaggaatcagactggcgaaactgtgcggatgtaaatcttacctccttagcaagggcgtccatctgctcgggcttcaggccagtgtaggcgaacatgccgatctggatatcacgtcagtgatttagaacataccacatacccagagagttgagtttgtgatcttacctggctggtgatgtgggaccagtcgtgcttgctgccgagcttctcgaggttggtgcggaggagagagcgcatctcgatgatgcggctagccatgccctcgacctcagagagccactgcttgttaagagcagggtcgttcatgatggtggaggcgatgcgggcaccgtggatgggagggttagagtagaagggacggatgaggatcttgatctgggaatcgacacgcttcttctcctcggcgttctcgcaaactagggagaaagcaccgacacgctcaccgtacagacccatgttcttggcgaaactctggcaaagagcgatgttgtggccctccttgacgaagtgacgtggagcaaaggcatcctggtcggcattaccgctggcaaagccctggtaggccatgtcgaagaaggcgaagtggcccttctgcttcatgacatcgctgatctggcgccactgggcctgggtagggtcgacaccggtggggttgtgggcgcaagcgtggagcaggatgatactgccctcgggggcggccttgatgtcggcaatcagaccctcgaagtcgaggccgatggtgtccttgttgtagtagcggtactgggcgacctcgagaccggagtcggagaagacagccttgtggttagcccagctggggttggggaggtagatcttcttcgcgccggggtagaactgcttgaggaaagcaccgccaatgcggagggcaccggtaccggagatggtctgggtgatgacgaggcggttgtccttgatggcggaggagtcggcgccgtaggcgagctcggcggcggcggtggtgaaggtgggcacaccggtgatgccagcgtactccttgtccaagcgcgatgcgacgaccttgtcctcagcggcgcggacggagggcaggacgtaaggcttgcccttgtcgtcacctgaaacagcggggatggcgcgtcagcaatccagtatccaatccattgcacaacacggcgattgtttggggcaatgcttacggtaggcacccacgccgaggttgatcttctccttgaaggagtcggccttgaaagcttcggtgatgccgagaatggcgtcctattgaccgagctacgttagaattggcctttcaagctgccattgtggcaattgcaagctcaaagcttacaggaggaccctggggaacgttggaccaggccgaggcgtgtctagctccggtcacgacggtgcgcatgttggcctcgcgggaggcagccgaccggctggcgactctgagagtggaaagcataatggcagagatgaagaaaaattgaaggaacaagacctagatctcctggatttgggattggaaggggaaagggaagaatcggaggtgagaaagaatataaaggatcggagacgtagtcccgatgtttttcgccctgactcatgtgatagcggtaccggatacctgccaattggtatgcaggtccgcctcggtttaggtaccaggtacaactgaccccggcgagatgtacgaatgggattggctgcatgctccgggtaaattgcaggggatctgctgtgtctacagggatttagttgctggatttagctgctgggtttaattgctggatttggttactggatgtggtgaattgttgatattttgtgtatagctttttgttgaattcattctggaatgtagactgagacaacattgaaaacattatatctacatttatgtacccattgatatcaacatatcaacatattaacatcaacatacatcagcccatctccaaatgggatttctcggcaagtcgaatctcccggtgaactgatcgaggctgtcttaactccacaccgtttcccctcacatagttggagaaagggatttctcctatttttccccgtgtcagagctgacactattcttactccccacaggaactcggttaaatacaataatgttaatcccttaaacttgtgtatgtattctaatacagaatattgaaatcggtaccttctcctcacacaagataactacactagttatggatccgttgatcaaggcttaatacacactacgagggttccgacttggggatacaacatacatatgtagacttcggatatcgtaaatttggtatttggctagtgaaatagtgaaaaaaaaagaaaagtatcagcccaagcgaacaccagcctggcgattcttgcgcgcagcagtgcccacagcagtgttcatgccggtgttctggctgctgtccagcgtgctcatagactcgcgcttcttttcttcatcgatcttcttcaaacgcttctcagtcttcatctttccactgcccttaccatggaactggtgactgagctgcttaaaggcttccttctggttcatgttgcgaccgaactcatccacataccgcagttggacgtcgggcttgtattcgcggttgaacacatcggccatatgacgagcttcctgctggtcacgctgcttgttctcccagcgcgcgtattcttcacgttcacgggccgacatgcgctcaagcttgcccgaggcgcggtcccgctcacgctgctgccgcgcgcgtcgctcgatttcggtctcgcggttcagcttgtcggccaagaaacgctggcgatcgcgcatcagtgcgttttggctggtgctgtcggtctctttgaccagaccgcgcgatttcaacatcgatagagtagcagcaagaccttggtccaaagttgattcctcttccaggcctgtgccgctgagttgttgtggctcggccgcagatacttcatcgcgcttgatgcgcgcggcgagctcctcttcgtcttcgatatcgccataacggtccatatcaatctccacaccctcgccttcgggctctgcgctgggactttcaggctccctggccgccgttgtgacgcgtttagcttcctgctcaaggagtgtaggcttgtgtagatttgacacaaactctgaggtttcgtcgataacaaggccaggctcttcgccttcattatcaggcgtttcgatctccattggagtctgagtctcctcttctcgaagctgcttggcaagctcctcggggctgatcttcttgcgcttcttgaaggctgcgcgccgctgcaacgcaagagaggcttgaagatcatcgtcgtccacgaaagaaacatcttcattgatgggcttgcggggagcagggactgggactccgccatttgagtcgatatccatggccgaggatccttgcgcatcggtcgaatccgcaaccggaggggcctcctcgtcatccatgaaagtcctctgttttgtagctttggccttctttttcttaggtttttttattttaacctcgctgatgtccatgtaatcggaggatggcacttcgggctcaaagtcgaggctgataatgttcttccgcaactggttggaaacttcctgtcgctttgcttcgcgttcttcggtcgagccttgggcgtcgagtgtaaatctcttccgttttttgccttcgatctcctcatcatactgtgaaagaataccctggttctccgccgtaggatcatagacgggctttttcttcttgagctccagcttctcttcggttctttccttctcgactaaatcgaggttttggagctcgtcgtcctcttcctcatcgtccaccgccgtgtccttcagcgtcaggatgtgatcttcgccacccccaaaagcacccgcagagtgtccgaccttgataccagccagatccgctgcagtgtactcagtttcggcaaggcgctcccgctctgcgagttcctcggccagtctctgcgcgcgttccttctcgatctttttttggcgttttttggattgagccagccaggccttagtatcaagttggtcgtcattcgcttcgcctagtgtagatccttgaagttgcacattcctttgggcgatatcacgcgcccgcttgatagcagcattcttttcatctcgtttccgtttcgcttcggcggcgtcctggaccttcttccagttttcgtagctctctgcctgtcgtgactcgagggtgcttgctgggtcttcttcctcgccggactcgctgtcgtcgtcttctctgaattctgggccggcaccggggactgggagtggcttgaggccgagagccactcggatcttgttattttgctcgatggatagagcgtccgccattttgacggtgtctggaggaggagggaaagagatggaaaggtattggccttcagcgcgacgccgtctggtttcctgataaccgcaatcgggtcacgtgatttagccacatagaactatacctatccaggcctagtgccataaaatcttagcggccccacttgtgacataaataagagccttccctctttttctttcctcttttcttcttcaccaaacaccggatctgtgtccagatttcctgtccacggactccagtctgactggtttctgtgtgacggttgagagctgggcatttcgacgagcttggagccatcattttcgtggatggcctttacggtttccggtcgacagatctcagaataagtgtctgcgccttgtgatgcgggtcttgagctcccactggtgagctcggcttgacagcttggtgtcggacggcgtcatatttcatatctctttgccgattggccgttggccgctgaggttagggaataaccatgacttgccaacatatcctacaaatagaactcgtatattgtaaacatcttggattgaagaaagtcttcgttttgcgggactacgttgtctaggaaacgtgaaacacgtattttggtatgcgcgcatatgcaatactagcgtgtcgtatgccgcatgtcgaacgcgatggattcagtaatgtttgaatatgttcgtcgaggtcatgatcatcattgcctatctaaacgcaagtaaagcacatgtataaggtgtgtaatttacagcagcttcaagtgtcccgtcacgccgtcaaccacactcttggggcccaagactcccagcacggtcttgctgccacttgcgatttgagtgcgcccagcatcctggataacgcgcgtgcaaagcccaaggctaatagcctgagcctgcatgaccagcaactcctcctcagacttgacctgcaacgcgatcttggcctggccaccgcgctcccatttcttgaggataggcgagttgggcgcgtattcaaggaagtatttgtagcaagcaagggtagcgtgaccgcattgggcggcgattttgcctaagaaaaagagatcgtaagcgcttgcaacacaaaatgcgaataactgaaacgttcgtagagtacatacctttggtcatgcccaggtccatgcgaacgacgagcaccagcttcacctcctcgttgttgtccttgaagctcgacagctcttcgccgttgccctcatcctcggtctcttcatcttcagagtctgattcgtcctcctcatcggaggagtggctgtggaccttcacatcgtagctgtttggccacccttccttctctttgaagaggttgagcgacgagccttggccaatgaaatatccggtcacgcctgcaatgatggctgttgcgatcacgtaggcggccgttgtgggaggcacccggtctaatggtgctggggcggccattttgagttggttggttggtggttgaagatctcagttgcggataaaactttgagggaaactcgaccgccctggatatcttcacgttttgttccactgcgctcaccttgggctcactttctttttcattagcttgataaattccaaatgaaccgcatttttagaggtccaaaatgtctctttgtatgttatttatttgagtattgccgggtgtgtgacctcgttgggcccgttctggctttgctacttgtacctacacttggtcttcaacatgtcaacaaccttccaattcgaacctatttatccgttgccgacatacgctggaaatcgtctgagaatgtcattatcgtatgcttttgtctcggggcttaacaatcattcgctccagtaaaaaaaacttgcctttgattcaggtagaatgttcgcttggtccctctgcggttcgtctattccgtctcaggaactgggataaccccctaaatcggggttatgtacatcgaagcctaatccttgttctcatgatcagccttccagttctcgtttccacccaagtaccggaacacgatccgtgagtccaagtccttgcatcgctcatcctcactggcttccttgtagatctgcaatcccacgctcccaagcacattagtcgatcccacgcgatgggccatgtccaaagccagcgaaatatccttcttcataagatggaccttgaaccccttcttataaccgttcgaggacggcgcatcgggatcaaccccaggcaccgggttgaagcgatcacagatggtgttttgagcattgccggcagcgtaaacctgggccaggactcgcgggtctagtccggacttcattcccatgtccatggcctccgagcaggcaatcgcgatgataccggagaggtagttgttggaaagcttggctgcgattccgagagacggaccaccgcatggaatgagtttgttccccatcagactaaacaattgtctgagctcctcgatgtccttggtgttgtcttcggcacagccgaggaagaacgcaatcattcctcgctccgctccgataacaccgccactgaccggggcgtcgtagaatgaggcgcggggaaagttcttgctaatgtggtctttgatctctaggaagctcgcggtgtcgatggtcgagcagtcgactagaagcttctgtccgacgtcgctggagcagattccatccgttcccatataaactgccttgacgtgctttccttcgggtaacatggtgatgatgatgtcctagtggatattacatcgcgttagtattttctcttcgaaaagcaagaagattaatgtgattcgagatacatactgatctgtcggcaacatccttcggaccagagcatgccacgactctatccggatatttcgcgcagatatcatccactagagccgggatgatatcaaacacgtggacactggaattgactggaagcttctcggccaagttggttgccatcgagaaacccatgtttccaaggccaatgaaaccaatggcctttgcctgcatcatcttgagattcctgcaagtgcaagattggacgacaagaggcaggtagatctcaagccagacggactggactcataagttcgatggaagatgaaaagaatgtaggaataaccaatgtctgagttctttaggggagaagaggaaagagagatacaaagaatcaagaatcaagacgaaagacgaaagacgaaagacgaaagagcgtattccatagacgcctcaatttccacgcacaggcaacagcggttgcagttgaccctgaaattgtcaattgatcctacaattgaattgttcttcgtccaatgttggggtaggttcgacctctttaacctcaacttgttaattcccccacaagaggcaacaagaatcgtctcaaatgaaacgacctaacttcggactacgtcttgctctttttttttttttttttttttttttttttttttttttttgtcagcaattgacgcccaagttgtcatttacgtctactaataccaaactccatgtccaagttcacgctcttcaggccggtcgccttgcgctgtgtcctggtggatatccttcaagacagcagtatcttgatagttgatgcaccagtcaatctccctgaatatatcaatttcctcgctcgcgcggccaggtcagcatacttactacctaggggtgcgtgccataatcgacgtgttatgagcaaagagggggagattggacactggcagataaatgtggccacaatggttgcacattggttgcattgatacaaacaaggatcaagctgaagaatcgattgagtcgattttgcagcttcagtctgaaggtgttgaggttatattagctcaggatgtcttgggaaagaagtcacagaatcaagctcgcgtttcggggccagctccactgagagagcgatctctaagaggaagtatcggaactatctcgagcttatgacatgttatagttgaattggatgcaatatgcaagcgcgtctggagatctatccacatctatgaaattgcttttatcccctggttcaacgaactctctatcctcttttattgagtgttatgatgtacaatacatctgcatcatcctcggattaacccaggaccgtatttcattccttcgcccaattcagagaatatacctcaatctgtgaagccatactgcatgcgaagacattaccacacactggcactgacgctatggaaatcgccaagaggatagacattaaacgagattggggaactggaaggagaacgggacttgggagcgaagctcaagcatggaaaacacttcatgacggaatatgcggacggtagcttccaatctcagaatgcattaatttaagcaatctttccttgttgttttcatgccgtgtgaactccaactcaagcgtaccgtgcaacagttgtcttccctttcttgcaatttcgacgccaaggaaacaacacattgagctggggtagctaggcagcttatcgacgatagatgtgtgtagttttccacatcttgcacgtatgccttctgtgacatcgtgatagtcttcttggcgcaatcccgatccagagcgcagttcagatactgctttggttctccgagatccttcatatcgtaaaactgacgaagctcatcaacaacctgctggatatcttcgtcgtgcggagcagcaatgataaaatcatcaacgtgtatcatcataaacatgtagtggtagttagtaaccagggattaatagatgtaagtggtcatactgagaaagccagaaccatgactaggttgggtttgatgggcttgcgagcttgttatagccggtttatatctaggtactacttcctagtggtccttgtcaaagacaatgatgttaaatcaagttgttaaaccaatcaatactagtagaggacgaggatacccaaggccttcgccgggatgctgagattggagtcgtcgccgagcttggggtagtctctgtcacttagtgcctttgtaaggacggttggtatgtttgacatttggttggcgagagaaggcaaatggaaactatatatgaggaatcacgacactctcaaatggctaagcgtccagccctttatataagtagtattagtcgtgtagtattggttgaacaggccaagaaaacgataaagtcgtagaacaagcgagctgcaagaaaagaacaaactgtgagtgtgagtcgggggtacgtaagttggtgcaatcgacttctctcatgccatttggtattcaagtcatgcaaagtgtcacagtgttcgcatacaaactgttctattgacgtgcagcatggctagatctaacctctagagatgagtgccagaacccagccatggtgtcccaagccgattctgctatgcggacaattctggggtagacccacggtgctgacggcagttaaaaagcgttagaataatcacctttgcaccttggatatcaattttgacaaatggagcagttcaatgctttcattttgaacatgggggataatatggggagcatccacatggtcttccccgggtgactctgaatcgggcgatgactataacctcgagtacgctggttcagggtgaggcagcaggcgcgttatgaagatagcagcatagattgggtagcaaaggggccacagccttgggatcttggaaaggtatacaaatcaattatattctgggcacagaggcaaggttgacctctggatgttatgagttactaatgcattcggtgaatctgttacaaaaacccgctagatttctgggatacattgattaaaaaagtagctggaaaaaagccaagattgaagaggccccatccccaacagatgtctgcccaacaagaacacaaaccaacccaagtagtatattggacgcgtcacaataactaccactgattatatacaacccaaaacaccaacatggaccaaaagaggctgtttagtttgcgctaccagcgggggcggcagcacgaggggcgtttccagtgggacccacgcgacggctcctaattccggcgttagactgataacaaacaacaagcataaatcaattccaacttacatcatggtacggctgaagaaactgataccgatcatgaacagccaactggggacagcaccaagaccccagatgacgtatcccatggggatgttgagctggtacttggcaacccagccgtcaacggggtggagagcgccctcataggcggggaccttctcgtagcccttcttggcgtggatctcgtagattttctcgggggtgacggtggtggagttcaggtagatgttgtggagaggagtaggggcacgctcctcgccaacagacggctccttggggacctggtagtactggacagagggagcgctggcggaccaggcggcgcatagaacctgattggcctcacagtccaagtatccgaggttaggtgaggtggggtcggcggagaacaacagaacggattcctggtaattgcgaacatgttagggtcttcatacttggtaaaaagacgcgtccaggaccaagcatcaacccaccttgaaggccttatcggcagttccgcagcgaccgaagcaggtcttgttaccaccagtggtgtagatcaaccagtcctccgcctggggtcctggggtaaggatggacttccagttgtccatggacacgttggtgacgctcttctcggtaaccttctcggccagcttctccatcggggcagcaacgggggcagctgtcggcacgtaggacttgacctggttgaaccatccctgcacgcggtcggcgaggggaatctgctcctgggccatggccagagcagggaggacggtgacgagcgaagtgaaacgcatcttgagggctgaggcgcggaacaagttagtgagacaggtttcgggaatgatgaatcaagtctaatacgatggaacttaatcgaggcacttaccaatgaccgaaaggcggataagaattggcacagtcagagacaagaggaagaatggtgtccagaaggagttgggaagacagctggcctgagcgcgggccaaccacaacactttaatttactcccacaacatctccctctttgcaccgatggcagcactccctatgctacttagttcaggaaatgtcccagattagttccagatgcatatcataatgtctttttatctatattgcaatcgactagatttttttgagtgcaaatcatcctggtccatgtggattctgacttgcatgaaagctcccgaccccacaactttaggtgccgttatgtcaacaattggtatcatgtacactgaaggccgagttttgctgccattgcatgtcttgaagactagatattacttatggccagaatgcgctggtgctggccgttatatactttccaaccttgttgaatagtacatatgtccacgggtatggatagaagatctaactaatgcatgtatcggattcgatgggatactttctatgaaattgatatggaaaagcgtctcatctcttcattcctagaatatgaatccatcgttatgggcccattccctacctatatatataacccatctttctctatgaataatttagaattagaatgatagcgatttcgtcggcgggagatgattggatgcgttcggaatgaaatatatgtacaatatagatcggaagtgatgcccaactgaacggcagcgctgatcttgcatctgtacatatgtattgagattcttgtcgagactgaagaacgatttagggttatcgttgaaccagttctgaatagattatgtagagctacaacgtcaatacaggccctgcaggaccggtggtgatatcgaatggttgaagagaaataaacatcactatcacacttggcgatcttcattgatctacacaaaattggaagacacacaattgcatttggaattttagtacccggaattgctctcgtactagtgattcaatatggttattgaggattttgggatacaatggtaaaatgcaagtgtgtaaactgtactacccatcctggggcctgcacctgggcatgagttgaattcatttgaaacataagacactaacattcaagtgcttccagaagttggagtagttaggataagtaatggtgcatcactacctgtccactgatagacaagtattttataaacgcatatctacctataggacctcgggagtcttggacctgctccacgcaatgcttagtgagcgtgtcctttgcacctgagtggcaagcttaataataggaaaaggctggcccctgagtaataataacctgttatatactattaatacgtgtaaaatttgaatgatccttgtaatgcacccgtttcatagcatgtcaacttgtgtgtcgacattataatttgagatctacgcagatcatatcccagcgcttgaggcctcgagccaactagaagaccggaaatgatgatgacatcacttttccgtttgcataggactttgtggatagtaagaatagaatgttttgagtctctcattttgaaaacaaagaatagtatagctgttatataacaactgcatatatcagtagaaaaacatcattatcagttggaagttgaggtggacttatgagtcagaaccccacaagtgcccaggtgaggtccgatgtcggttcttagccattgaagtaaattgcataacacatgctgtttcaatcagaaatttcaaattttggggaagaaagcaattggaaatggacaaattgagtaggaaataatagacataccaaaattttacctcgtatattagtagaaatccggcaggagatttgatcctatctccaaaatatacttcccccacctctccacaatcaaaaatttcttttttgccgtccaaagggaggggcccatttactcggattcaccgcccactacttcactgtgaatttatgactcttctcttttcatttcttacaaagatcttaaataccttgattttccttttcgatcttgacctcggattatccttaacttttgcacttcgtcctcctcatctcgactctacacactcaaaccctcccccaccatctgcaccatgtgtaccggtgccgactccgagcccaatggtgctcctgccaccgtcgctgccagtatgtcaattgaaagtcactgcgccagaatttccctctaacttttatttagacggcgaccactctggtttcgttggcattgaaactcgccagaacccccacccctccgcatcccgcaacccctacggccacgacgctggcgtcaccgatttccttagcaatgtctcacgcttccagattattgagtctactttgcgtgagggagagcagttcgccaacgctttcttcgataccgccaagaagatcgagattgccaaggctctcgatgacttcggtgtggactacgtgagtcatcggccaaacgaatagttcatatccataaacagacattaacgatagtaatcacttagatcgagctcactagtccctgtgcttctgagcagtcacgtgcggattgcgaggccatttgcaagctcggcctgaaggctaaggtacgttagggttttgatcgggtctcgtgactattggtatctaataacctgtttagattctcactcacattcgctgccatatggatgatgcccgtattgctgtcgagaccggtgttgatggagtgtgagttgtgcatcttgtccttgattttgttgactcagaactgactttgtctagcgatgttgttatcggtacttcttcttacctccgtgagcactctcacggcaaggacatgacctacatcaagaacgccgccattgaagttattgagttcgtcaagtctaagggcattgagatccgtttctccagcgaggactctttccgttccgacctggttgaccttctgtccatctactccgctgtggacaaggttggtgtgaaccgtgtcggtattgccgacaccgttggctgtgcttccccccgtcaggtctacgagctcgtccgtgtcctgcgcggtgttgttggctgtgacatcgagactcacttccacaacgacactggctgtgccattgccaacgccttctgtgccctcgaggccggtgccactcacatcgatacctccgttctcggtatcggtgagcgtaacggtatcacccctctcggtggtctgatggcccgcatgatggtcgccgaccgcgagtacgtcaagagcaagtacaagctcgagaagctcaaggagattgaggacctcgtcgccgaggccgttgaggtcaacattcctttcaacaactacatcaccggattctgcgccttcacccacaaggctggtatccacgccaaggctatcctcaacaaccccagcacttacgagattatcaaccccgccgacttcggcatgtcccgttacgtccacttcgcctcccgtttgaccggctggaacgccatcaagtcgcgtgctcagcagctcaagcttgagatgactgacactcaatacaaggagtgcactgccaagatcaaggccatggctgatattcgtcccattgccgtcgatgatgctgacagcattatccgtgcctaccaccgtaacctgaagtccggcgagaacaagcccctccttgacctgactgctgaggagcaggccgcatttgccgccaaggagaaggaactccttgaggcccaggctgccggtcttcccgtataggcgatttcctttcaccaatacatatattgtgtcatgctatctcacagtggcttgtgcaaagacgtggcagatacctgatgatttgatgctttttcatttgttttgacattttttttccatataaggggttgaaaagtcttctttttttttttttttaccatcttggtcttttgggagagcaaagacatttgtgctaggagacaagagttctccttaatttgtacatttagcgcagaaggggcaatgacttattctgaagactgttgtgcttctatatagtagttgtagatgtacctaggtagtctggagcaattacgtcagtggagaaagaccagaacatcgtctacgaagagtccatctagtaactcgtaaggaattattatcatatgggatggatactatttcaagtctatgaatacataaatacataaattttatacatatattatgtatggatctccagacctcttgtcctgtcattatatgcaaaacgttgagcgcctgcttcatgtgggagccgaggcccgctaagactcaaccagtcagaacgtactaacgtactacttgacgaaatgaaacctccccatcgccactcccgcccatcattattgcaggaatatttctaggggaacaatgagctcttcaatgctgccagttgccctgcagaataagctggtcggctacggccgggtgtccagcgcccacctttctgcctcgaactttgacctgtaagttgagtaattcccccgttccccgcggaatcgggcccagaacaaaaggcaaaaggcgatcaccactgacacctttcctcaacacagtatccgcaatatcgtatttatcctattcatccttcggtatacgcgcaagaccttctactccatccgtggctacggcatcttcggcagcatccgcaacatctatatctccctccgcctgttctgctacagtatcttccttcgcgtccctggtgtccgcggccaggttgataagcaagtgagcactgcgatcacgaatctcgagtcgaagctggttaactctgggccggatgttacacggtatcttacactgcccaaggagggctggtcgccggagcaggtccgcgctgaacttgacaaattggctggacttgaacatacccgctgggaagatggtcgcgttagcggcgccgtttaccatggaggtgcggagctgttgaagctacaggctgaggcctttgggcagtttggtgtcgcgaacccgattcatccggacgttttccctggtgttcggaagatggaggctgaggtggttgctatggtatgcatattattcctatgtctagagtacggtatttgaaggagcattctagctgatgtctgatctaggttctcgctctgttcaatgccccctcggatggtgccggtgtaaccaccagcggtggcaccgagtctattcttatggcttgcttggctgcccggcaaaaggctttcctggagcgcggtgttactgagcccgagatgtaagttgacgtaggaatactatatggtattgactagtaggactgatcagtcatcgcaggattattcccgatacggcacacgcggcatttatcaaagcctgcaactactttaagatcaagctgcaccgagtgccttgcccggagcccgagttcaaggttgacgtgcacgctgttcgccgtttaatcaatcccaataccgtccttcttgtcggatcagcacctaacttcccccacggcattgttgacgatatccctggtctatcgcatcttgccaccaagtacaagatccctctccacgttgactgctgcttgggatctttcgtcattgcccacctcaagaaggccggcttcccctcgccctacgaggaagagggtggctttgacttccgccaacccggtgtgaccagcatcagtgtcgacacccacaaatacgggttcgcgccgaagggtaactcggtcttgatctaccgcaacaaatcataccgaaacaaccagtatttcatctaccccgattggtccggtggagtgtatgcctctccttccgtggcgggctcccgccccggcgctctgatcgccggttgttgggccagtctcatgagcgtcggcgaggctggatacgtcaacagctgcaccgatataattaacgcggcgcggaagttcgagacagccgttcggactgacacgaccatctcactgcacatggaggtcatcggtaaccccattgttagtgtggtcgccttccgcagcaagaacggtgccattgacatttatgatatcgccgatgacctgtctgctaaaggctggcacctgaacgccctgcaatcgccggcggccatccactgtgccttcactatccccactgctaaggctgtcgaccagctcattgctgatctgagtgaagtcatcggcaaagagcttgaaaaggctgagcagcgcaagcgtgaaggcaaatcctacatcctcaagcgtggtgatacctctgctctgtacggtgtggctggcagcattcccgataagagtgtcgtcagccgtctggcagaaggcttcctggacactttgtacaaagcatgagtcttggcatgaagatgtcggtttcttgtttgtatcttattttttcagcctgtccggactgctcccaagacatagtcctggtgcgttctagctgtccttacccaaactgctggtgcagtggcgttatcattatccaagttctttcgaattgcacataattgtttcaagtgttggattccactagacggtaataatgcatataatacaatagtttgccagaaagacattcgcccgatagatgtggacgtagagtacatgaccaaaagagaaaacaaagcaacccgctccatgcaagcaaagccaaaacagaaagaagaggacgcgatcgaccaatcgatcaatcatccgtccgagtagaaggcatttcaaaagacccaaacctcatctcagtcttcgagaccggtgaaaaggaaacccagtctgaaaagcatgtcattccacgcgaagttcaatgaaaacaatcactgaccaccgagctccccccgctgctcagcgcagctcttttcgatatagtatccaggatcaggcttgcgctcgagatgcacctcctgtttcgtgaggcggtactggcactcctcaacgtgaacaagttccttgactttcatgatttgacccgcgacggagggcgagacgctgtggaagactgttgccatacgcttcttcaagccaagcgccttgagaacgtctgttgagcggcgcgggagtccaattgcggagcgaatgagggtgatgcggaagtaggacatgttggatttgtggagatcgagaggatctgatattcggatgttgttctttggatggtatggtttggaggttgtccggagtcgcggaatcggactcggaataggtgggctggagcgcggtggacgcagggatatccgaatatcggtaaatgaggatccgcagccgatatctgcagcgtaattgatactgtgatctggcggagaaacgtcgcagacttggagattatcgcgaacccgcaaattcaattagaaggcggtaggtcacgtgtgtattctgccccgatccgatgacagcagcgacgacaatctatcggcctgtgatagttgatatagtatttcgcatttcaaaagcggagactatgggctgcgctcttctcagtgtgacagtacctggattcatttcttagttcgctgctgttacttcccgcaagcaacgccccatgcccgcattgttgacaactcacccctcgacctagcttcgagcgattgagccggaacaacgacaccacgagatccctgattaccttaccatgaccatggcacaagccagtaacattgagactacggtcgcgctgccgcgacttgaagacctcctgcggcacccggaggatctagacaagatcagcgggcttaaagcggaatacctgcggaagaaggcggcagttgattcacgattgcgtgaaggtctgcgagaccagctggaggccgtgcaacgcagcattggtgctctaactgagggccagcgacaagtctcgaaaacgaaagacgagcttcaagggatcgacaagctgtgcgccgagtcgcaggatagcgtggaggactttgcgcagattgaccaactcgcgcggatccaacgacatttcgacgctacgcttatgatgaaacggggactggagaatttcgacgcggatatccaggaagtcgaggatttgctcaaagacgatgatgacgatatggagaaccagcctaatattctgcgtgctcatatgcagatctcgcggttaagggatttccgcgatgaggctatggatcagattcgaaaggcgaaggatccgagctctgaagagactctgggagagtactttaacaggttggattccgttattgagtggtttgatgaccaccttggcacggcttgcatgaacctcatccccttggtgcaggcagataacaagagcatggttgtgcgtcttgctgttgttgtattgaacgaggagaaaaatgacgataccgtccgagccttgcaagaggctcagaaagaccacaaggacctcgcaagtcgtttcaagtccatgaacattggtcccaagactgtgcggggttacaaagacaaattcatccaagctatcgagctttacgcccaggggcaattcgaagagaccctcgaacaattccttgcagatccggaaaacctggaaaagaaattccgatggtacttcaatgatctattcacggtcaagcaaggcatgcagagccttgtcccgaaaaaatggaagatattcaaaacatataccgatatctatcatcagatgatgcatgacttcctgctcagcttgatcgacgataccgagcttccagccgataacctgctcagtatcatccactggagcgacaagtactataagaaaatgaagaagctgggctgggcatcaacagaactccaacccaacattctcgacgaccgcgagccagaactagtccgaaagtggcaggccgtcatcatcaacgccgtcgaagaatggatggaccgaattttcaacgcggacaaaaagtccctcgtggaacgtgccgcagatgccctggacaacaatgcagaaggccacttccgcaccaagacactggctgacatgtggcgcatgctccacgaacaagtcatggcatcaggggcatcagaccgtgcagacctggtagagggcgtcatcgacgctatgttccgtgccttgaagaaccggcagactgcatggcaggcacttgtggacgaagaatgcgcaaagcaccaagtagaaggcgcggaccaagaaggcgtacagctgttacaagactggctgatcggcatagccaacgaccagatctcctgcatcgacgacaacgaggagggcaaccagttcggctacctgacgcggttcaagtccgatttcgagcctatggtcacaccaaagtacatgggcaccacggcaaccatcgagctggattccctgcgcgatggctacgtggatctgagcacgcactgcctggcgcagttcgtgagccttgtcttctgggtcgatctggacactgtgctaccagacttctacacgtcccgctggtacggcgaattcgccatgaagcgtattacctccacctttgaagactacatggcagactactcctccgtgctgcacccatccctggccgagatcctggtcgaggaactatcggacgagctgctggtccggtacctgtctgcagtgcgcaacaagggtgttaaattccgccgtaacgtggaccccttcacagacaagttcaaggacgacgtccttactgtctttgctttcttcgagaattaccccgactcattccagggtactatcaagcagaagtggcgactggttgattggcttgttcgtctccttgccactgaaaagggccccgcgcttgtggaggtttacgaagcattcaagcttgagtactgggatctgcagctttcgtgggttgaggctgtgctgcgcacccgtgatgatttcgagcgcagcatacttaccgccatcaaggctaaggctgcggagttatctgttgaacggggacaggagaccatcatgagtcggttgagatgatccagtggtacttgattgggggacattctttcaaccacacctaagatgccatttcatctcagctcctcagcagttcaccggcctcatttcatcccattgtcacgggacccgggctggggtaatcgccctctggctttcaatgtcccgtcagaatatcgcagatatgccctaagaagaggtcatagagcctctcttcgctgcgctgccgacgcagggctacacttcgacacaactcacctcacgatgagcaatccccagcatacgtaccatccacaacccaagcaggcttgggatctagtctactcattaatatcactagcaatacagaaatggaagcaaatatcctaaacaatctagtattctcataaatatgtccaaaaaatgatcctatttacgtgtattattgccaattgatcatttaccgtcaaatgctgttcaacaagggccgagagtcaagtcatggatttagactccgttctgcaacgaccgtatattccccgccaaggcgttcattcaaaccatgatcgtcgttgacacctggatataattctttggcgcccatctcgcagatgcagatagtatccagagggatttccttcgcccaaacgaaagggtagccccgcggaagagaagcggccgaatggcttctgtgctcggaggaaagaatgtcggcgtcagggattggtgacgatcccgtatggcggtggtcactttcggtgtcctcggaagatccagcatgtgctgggtgtgggatagttcgattgtcatcagagtagtaattacgatattgtgagatgaggttgcgggcgtcgaatgttaggcgtttgggaggatatttgccatttgcatctttgttctggccccgtcgtccgttgacgtaaattgtgttgacaagagtagcatgcaggagcagtggtcgcggttttggttctcgagttattacaggtatggatgggtccgggattttcgacacgtctggggactcagagggattttggctttcttgttggtttaaagatgcatcactagaaacggtagtagatccggaggcctgaaggctgtcttggacaaagcggggattcttttgtcttcctgctggccttctctcgagctcattctggataaagccagcctcaataaatttgtcacgtagctttacgcaaaatggaagtaagcggcctgtaggatcgaccggagaagcatgtagtatggttgctgatttgtcttggggtagggcatgtaatgactcgagagacacagtcaagggcgacgacagggtgctgttctgttgtgtgtgagcggtgattggctccgcctcgttcatcacgtccgccagatcaagggattggaaaaaagcaagagcttgatcgagacgttctttgctggtgagactcattactccaagcgtaaggtgaattgtgcccagtggacgaaaggctgcgctgggaagacccaggcggaagttgtccccctccttggaggacgattgagtagctggcccgggttccgcgagatgggttgttttgaaggctgcgagcgattcatccagctgcggcagagatttggtgtttaccagagggagacagaggaaatgtgtcaattgcggccgcttttgccgcttttccgggcgtggtttgcggttctgctgccttgatacgtttacggtctccgtcatgatgcacctgtatccccatgaacgtaaaagcagcatggaagtaaatcaattttcgcgcgatccggtcgccgaaatcgtctagagagttgctgttaggaagaagtcagaagtcagaagtcagatgtcagatgtcagaagtaagctttccaaggtcgagagacgcacggaccatggtccacaaccttgtgtcaacgtgagaatttatatctctcttggccttcaacaccgaagagattattcaatgcttccagcatgatatgcatgttgacggtgcctcttagtgcacctgatcagttgctggggtctttctggggctggtcctaggttgatggtcgagggcgaaaggtgagggcgatatgtgatggaagttgcagtctaatcacctgggcacacagtgatatgattcataatctctgctagcgggaatgtgatgctgatgacggcaacatctaaagattcgattgtcagtatgggaggacgagagccaaataggaaagcccaaggtggtataaacccacgttggtcgatgacgccgatccacgtaaaagagaaatagacgcatttccctcacttctcattccacccaacatggctcaatatattctcaagataaaatccatattccatcggcatccgaacaagaaaccagacaattttcgaaagattccaccagagatagtggatatactctttacattccttcaattcgccgaccaagtttgcctcgcgctaacctgcacatatctgttcgcttgctacaagttattccttcatgtgcgtaaaacgggagttcctgagcttctataccgcgaaacagttgtggaattgtgcttagttcatcaacttcagcatggctgttgggggcaattctgctggcgttacaaaccccacccatcttgcggacgcgcatttctatggatatgtggatacaggggaaagcgctgttctgtttgtgacctagtcggctaaatgtatccttcatgcctaatggaaaaccctgcccgactacatcccatctaattatcgcggtgttctttgctccgcgataccatgctgtcttgcccagaacgtccatgggtgggaataagcgtatccaagtgtctctggcaaatggctgcaattagcatcgatctgatgttgtttgagcagaggggagaatggaaatcgggcatgtgaacagagaatccactgccttattgcagttgatcgaataggaggcagtcaacatcttccgaaggtggaattctcaaccgaaggggttctatgttgcttcttgattgtggaagcgagaaatccttagcaaaatagaagctaatttagctattctctcttgattcttccccaactttatcccgaaaagcaattattaggcgtagctctacctgtataggctcaattctttgaaggtcaatgtgttgtatgatgttcagttttgattcttcacattgactgctgatacaattccgcttctgtaatttgactgtggccaccagtccatccatcatcatcccagtccatccatcctccatcatattcgacgattcgttcggtgagcaagcgttcactcagtgccttgtcgatctgcggagtgttggaggctcttctggtaatggccgtgttgttgctcttcgttttgtctttgtttttgagacggccccggggtgttgcaggactgactaagcatttcggttctgcatttgaaggcagataggttcttcccgtaacagacttgttagatgcccaggcctcaatgacccgatgatgaattccacatgttgccgccatcaagcctgatcaagattgatcagaagttgagttgagctgtaggcagggcgagtgccaaggaaatttgagtcgatggcagatttagtgagattggcagttggtatggacctggaaacccaacaagcgtcagcaaaagctggtaaggtccatcatcgcggaactctatctaactatctaaggaggctggggggtggaggttgtccgtttgggttatattcaacctcctttccatgtgttgtccgctcagggaccttacctaaagatgcaggagtggcaatcgctttgtcttgtatgttggagagacaggtgcggagcacagagtggcaagcaggcccgactagacggcacggatgtgttgatgtctggtaaaaaccaacaagcgtcagcaaaagctggtgagatcccatcgcagaacctatctaactatctatggagggtgacgctggtgcgctcaacctcctccccatgtattgtccgctcaggaacctcacctaaatattcagtttgttggtgtgggtgcatgcatactgatgtatgctgcattggaaatccacttgcgagtgcgttcaagtgggcaacaagttggcaggtcacggtgagtcagctggtagtgtggatatgcctggtaaaatccaacaagcgtcagcaaaagctggtgagatcccatcgcagaacctatctaactacctatggagggtgacgctggtgcactcaacctccttcccatgtattgttcgctcaggaacctcacctgaatgtgcaatgtttggattgccagtgacgatttcctcggtaccatgcattggaaaatcaattggagtggattcgagtcggcagaggctgctggatcagctatgggaatcagccttgaaaggcggccggaagggcaagtagctctcggcgtcgacttggagtgaccaagttgggaaatttgctgactccgctgtgggtatggaggtgcctggtaagaaccaacaagtgtcagcaaaagctggtaaggtccatcatcgcggaactctatctgactacctaaggaggctggggggtggaagttgtccgttttgtattctacctcctttccatgtgttgtccgctcagagaccttacctgaaggtgtaggtgtgcggatggaggtatttgtctctgcctttgacggtgacgttggcggtgatgccatagcctgtagtgcgggcgtggtcaacacttatcgcaggcaaggccctgttcgatatggcaaagtggcaaagaatgtcaagatcactaaaggcagaggagagaaaagtttccctgcgtcagccaatggactggtgaggtctcccactcgttgcgagccaaaagaaccgtggggttgaaataacgctggagttctcacctggtatgaatcgactgccacagggcaagaagaacggtggctatagtcaaggtagttcatcgaggtggttgattgaaatggttagttgatcagactggcctgccgattgtcctgaagccgaagcccgccacggtcagactggaagtgcgtgatcgaggctggtcgaggtggttgattgaggtggttgattgaggtggttgattgaggtggttgattgaggtggttgattgaggtggttgattgaggtggttgattgaggtggttgattgaggtggttgattgaggtggtgatcgaagtgtattgactgcccagcctgccgattgtcctgaagccgaagcccgccacggtcagactggaagtggtcgatcgaggtagttgatcgagatagtggatcgaggtagtggatcgaggtatttgatcgaagtggtggatcgaagtgggatagttgactgaccagcctaccgattgtcctgaagccgaagcccgccacggtcaggctggaagtggtcgatcgaggtagtggatcaaggtggttggtcgaagtggttggtcgaagtgggatagttgactgaccagtctgccgattgtcctgaagccgaaaggcccgccacggtcagactggaagtgggtgatcggggtgggtgatatcgaggtgggtgactgaccagcctgccgattgtcctgaagccggaaggcccgccacggtcaggctggaagtgcttaattgaggtggttggttgaccaaaccagctgccgattgtcctaaagccgaagcccgccacggtcagactggaagtggtttgttggagtggtttgtggaagtggtggattgaagcggtggattgaagcggtggattgaagcggtggattgaagcggtggatcgaagtggatggatggatcggattacttgaccagtctgccgattgtcctgaagccgaaaggcccgccacggtcagactggaagtggtttatcgaggtggttgattgggggtggtgatagggtgggtgatcgaggtgggtgattgaccagcctgccgattgtcctgaagccgaagcccgccacggtcagactagaagtgggtgatatcgaagtgcattgactgcccagcctgccgattgtcctgaagccggaaggcccgccacggtcaggctggaagtgggtgattgaggctggtcgattgaggtggtcgagtgaggtggtgatcgaagtgcattgactgcccagcctgccgattgtcctgaagccggaaggcccgccacggtcagactggaagtggtttgttggagtgggtgatcgaagtggtggatcgaagtgggatagttgacggaccagtctgccgattgtcctgaagccgaaaggcccgccacggtcagactggaagtgggtgatatcgaggtgggtgattgaccagtctgccgattgtcctgaagccgaaaggcccgccacggtcagactggaagtgggtgattgaggctggtcgattgaggtggtcgattgaggtggtcgagtgaggtggtgatcgaagtgcattgactgcccagcctgccgattgtcctgaagccggaaggcccgccacggtcaggctggaagtgcttcatcgaggtggttgattaaggtggttgactgaagtagttggttgaattggcttgattgaaacagttaggtgaagtgaattgtttgaccagcctgccgattgtcctgaagccgaagcccgccacggtaagactgcaagtgtttgattggctggatggttgactggaagattgactggattgactggagaattggctggaagtggagattgctgactgaaaggattgactggatgattgactgggttggctggattgactggattgactggaggattggctggaagtgtagattgctgactgaaaggattgactggatgattgactgggttggctggattgactggaggattgactggagaattggctggaagtggagattgttgactgaaaggattgactggatgattgacggggttggctggattgactggattgactggagaattgactcgagaattggctggaagtggagattgttgactgaaaggattgactggatgattgacggggttggctggattgactggaggattgactggagaattggctggaagtggagattgttgatgaaaggattgactgggtgattgacggggttggctggattgcctgaattgactggattgactggattgactggagaattgactcgagaattggctggaagtggagattgttgactgaaaggattgactggatgattgacggggttggctggattgactggatgattgacggggttggctggattgactggattgactggagaattggctggagaattggctggaagtggagattgttgactgaaaggattgactggatgattgactgggttggctggattgactggattgactggattgactggattgactggattgactggattgactggattgactggaggattggctgggggttggctcaatggttgactggatggatgacttggtggatggtggactggatgggtgaatggactgattgggcggttgattggatagatccctaaaggcagaggagaaaaaagtttccctgcgtcagtcaatggactggtgaggtcttccactcgttgatgcgagccaaaagaaccgtggggttgatcacgctagagttctcacctggtatggagatcaaacgccacttggcaagacaagaagtgtgtatgatggacaatgcagaagtgagatccctaagaagcagagaagaaaaagtttccctgcgtcagccaatggactggtgaggtcttccactcgttgatgcgagccaaaagaaccgtggggttgataacgctagagttctcacctgaaccacgacgggtcatcatgaggcctttcatcccatgagcagagggaagacatcaagcggagtcggcatgaatcacaagcatagacttgtgttttggtctctgtaattcattagctgggtagccgaacaggttccaacattgctcatcgatgtgggacatgaaggaacgataagcatagacacacgatggggtattgagaggcgggcatgatggcatgatacaatggtaccatgggacgaaagcaatattacaacatgagacgaacacatggagtggttgggaaggggcacaatgggaaacagagacaacaaggcgagacataggaaggaaagggaaggaaagggaaggaaggaagcaacggaaggaaggaacaaataatggaaggagcaaatgatggaaggaacataccagtgaacatcaccaaggcgacgtgaccatggtgtagacgtgaccatggtgtagacgcgtcacatagacgcagaagaagagagggttgtagagagaagatggccatgaagccatgaatgatgaacaaaagcccaagtcgccatggggggatgaaagattgatgaaagattgatgggaagtggatgggaagtggatggacagatggaagcaagatggatgtaggaggaagaaaaaaattggaagagaagaggggggaggagggtatttataggttgaagctgggagtgaagctgggggttccttctgttttgggaaaagtagctaattactagtagggctgtctcaaatagggaaagtaccaccctcactaagttaacatgtcgcatgtctccactggctatacgccctgtctaaggagatgcgacagcgaagtccaagagtcagtctgggaagtccattgtctcccatttggatatattggtatctacgtcggtatattgatatcctgtacggtattataaagatatgcagccatctatgtccatctgcagaggcaagacacacgtcccctttagacaaagcataagcctgagatcacatggacacgttagccacgtaaactcatctcatacacgtccgacgccgaagatatcgacggactaaatacattgaaccgtacaagcaaggcttactagatggtgacgcaggtgtccaccggactacacggcagagaataaccttcaaacgagatgctaggaaagacatgggaatattcttaatgctgtaatgcgtctacccaaggtgatctctatcaagcgaactaggtattcagattaccaaagtcctatgttgtctttagtgaagtctggatacgcagccgagtacctgtatatataatacgtggagtatatggaacgatgtgccgtagatgtaatctcattataatgatattcaccaagtcaggaaaaggaatccaacaggttgtaaacgccggtgatcgaatggcccccgcgccatgatggaaattcggcagacaggtagagaagaacatagcatagtacgtagggtattccattctatactagaaagtacatgtaggagacaacggaaggcccaagacctcctgccaatgacactcatgaagtctccttcttgcgaccctcgacaacgcgcataacatccgtgacactatctttgtcacccttcttcttcttcttggggccacgctttctctttttcccgcctcgctcgttgtcgtcaaagtcgagcaggggaccatcgtcttcctcctctccgtcttcgttgcggcttcctccgaatcccatatccatatctgcagcatccatggcgtcttgccggcgtgcttcttcaatgaagcgcttgttacgaagggctgtatcagaagactgatcttcttcaccatctgccgagggagagcgctctcggagggctgcagctcgtttgagggcggcaagaatggttggatctcttgtgaggggattggatcgatcgacagactcctcttctaatgtagtcgaggtcccagtcgcaaagtagttcttgggtttcacaggtgctgtttcagacgcagcaggctccttctcttcttcactgacaaaagccttctcaggttttctagtagccgcacctgccacttcgccatcttcatcagacgatgactcgtcttcgagtccagcgagaggattgtaatcatcaccgacaccggcaaatatgttgtcgtcgtcatcctcgggtgcctcttgtgcagcggcacgggcagcaatatcagctggaatatccataccgaggggtttgacacttgcatcgggcatcataaggtctcccgcggcaggctcaggcacttcaactggcttatcaagccacctggtcttcctcttcgtgtttccttgcgcatcggtgatgaggagcacttcgcgtcgacgaccggtctcatcacgctccacaaatctcttcttctcgggctttccatcgctcagcttcttgaattttgagccgagtatggactccggcggcggagcaggtgcggcagcagcccggcttgccctcaattcccgcaggatttcatcgcgggtcttaggcctagcaggcggcggtgccatggtccccttcttcttttctttctgttgcttaggtacagcggaaatctcctcgagccccttctcttccatcatacgctcgaattcctcatctgcgtcttctttttcggggggtggagcaggtttttcggccgttcgcgacacgtcctcaccagctctgacccttctcagtagatccatatccagccctttgaccatgtgtgtgcttgcgaggtcacctccgactccgaggtctcggcggagtttgtcgaaggtagcttggtcgatttgtcccaacttaaccatatcctcgagtgccttgatacgtgcctccagacccgtgctgttctcattttcgtcctccgcattgcgcaatttcgcacgatcctgataaccggtgggtagcgaggtacccttgggcgcggcggaggacttgaatcgcttcgaaggtcgatcgccctcgcgacgttggtcaaatagctgacgagcaaagtccacaccagtaactgaacgtctagagcaaggccatggttgttagcttcctccgaaatcatagcaatccgcaaatctagcgacgtacggtgtcatgggaatactggaccgcattcgcgaccccagtgacccgcccggagttgcgccaccacgcgacgtatcgcgaccaggcgctgggctctggtcctttggttttgatgatgactggtcggctagtagccggcgaaactgctcgttattcatgattcgcgagctcaagttgcttgggattgaagttaagaaaggctcatgtttaagaagtgaagatccggcttggcactgataagactatctccgaacaagcttggtcacattttccctaagcaagatcggcatttcaatatgaaggcaacctagtacttgcatcgctattctctaatttgaatctacttgacagatggcactgctcggtgtagaactggatgggtgggaacttggcctagcggttgttggcgacattggcgcatgcctcttggatccccgtccatcctcagctcgagtgccgtttgatctcaagctgccggactccgggcgatggcttttgtatttttttatgattcttgtccgatatgtactacgagtgaactaggtatatggaccgtaaatgtgcaggatatagaaagcatgttgggtatcaatatatattcatcgctactaggtgactcaaatgtctcttgccatcgagtgaagggcgggaagacatatgctaatagatacaggagtcaggtcactcgcaaattttaataatacagttaaaaaaagaaaaaaaaaaccaaaacaccgagaacatgacgaagtcggacttaaccgccttgttctccttccagggtcgaggctgatctgaagattcgcttcatctcgtaattcgtggggatgtatgaatcgggcagaagctccacagcgacctcaaaatcaagaagcgtcaaagtccgacttttcccttgcatacagaacattgtgcatccctgggtcgtccagacgaatggagattgaccgaaatgcgtggattgccttcaagcattcaccttcaacataagcccgctcgtttgcgttcaggctatgccatatatcaaaagtagttctccctcacgacgttccagtatactcgcataacctgctggaaacaaacttgagcacaagatatttccccttgcgatgcacttgggaaaaagatgatggccggccggacggttcttgtggaggcgatcatacacagcagcttcagtgtcgaacctatatcgtctctcttccctcatttaggtgttgcttgtcgcagcggtggccgaggaattgcggtccttcttccccattcccggtgtagggggagggaagagtgtccattgagttgccagatacgtcgtctcaaagtgaagagaggtcaaactgagatgaaactgaatttccagatacaagagtaggtcaaacagtaaaagaaaaaatcaacaagcaacacggcgaacaaacagaggaatcagtgttgagaaaacaacgtgcgtcgggtgttgaacagtgcagagttagagaattggaataggtatatcaacgttgagagtgaaggatcaatgtggagaaagcagaaccggtagatgaagttgggaaaataaaagatcagagttgaaagtgagagacgagtagggtaggtacagtgggtagacattgtgttaactggggttagcactaagcctatttgggaactataaaggaccaaccttggaatatatgcagcataataaagtcatgtcgactacctcgggggaatcagcaatgatgattcacatctaatccaaattcgagttgaatgtagcctggtatttttgaatcataactaccaagtgaacctattgatgaaaaccatgttcgatatacagtgaaacagatgaaaacagagtagtgatgcatagtgacgaaaggaaacgagaaaggcgattaaaagacgcgatgaggatcgtttccaattcgccgctaaagattcgaaagtaagaaatctaagcgcacgcacgccaacaagcgcaaaagaaacccaattttcgttattctttagatagtctcccagcctccgttgttcatctcggactccagcttgcggctgatggttgcagggatcgagtgtgacaaccaaacatcgcgcagtagccggtcgtaccgcttctgattgaggataagctggcggttgcggcggagaccggggtcgacttcgccgtgacggtcgaggtagggcgcgtaatgccatgatccgttcgtgttgtgcagatagagaaccgtgcatttgcgaatattgatgaaaagaccaatgtttttgccgcatctattatggaagactggttagctgaagagtacatgcaaggagtgggagggtataattacttttgacgatgttggttgcagccgccaagcttgtttgtcatgcagcagactgcctgtgagcagaatatttctccgcagaataaacagatactggggtcagtgagctccttcttcgaactggggcaacggcgacggtttgcctcttcaataaggctatcaaagtacttgggcaggccaaccagctcaaagatagcagggtgcgacagactgggccagagacggtggtcttcgaagcggatgcctgagcgcgaggcattccagtggaagatccatcctgaaatgactgcgtcgaaggggctgttcgtctttcgtgcgggcttgacagacacgagaatctcgtcaagagaaggtagttgaagtgctttggttaggcgctcaagctcagaggactccacatcggcgaatcctgtgttagggaactcgacgccgtgctgaacatgaagaaggataactgccttgcgcaagaatgccaatccatagctcgtaacaagtcgccgcacggcagtaatgatacctggggtggcagtttcctctccatctttgacataaccactctcagcggggaaggaggaaccttcagcacggccaagcgagttcgccttcagttcagcaacgatcgagtcgaagaactgtttggtcactccgaattgctcttcagatacatcggcggccatagtatggtcctcggggtgggtggcgagttcctctttcaaacccagcggccaaaggatgaaagtgacagcgaccttaacaatctcagccacgaagcatatccggacaagatgtctgatatcaatattaaggactggaagcagggacaatgatgactctgcgaagaacacaaaggtatccacggcgagcagaggctcaatgttacggacatcattgagcaaagctgtgccactcaaacaagggtgcccgacaagtagctggcagatcttttgacgatgcatctcctggaactcattggtcggactgctttttgacggcctcgtggtgtgaagacacccaacagcagcatatgtcaagaccgtctctgatagaacgcgcagatgggtaagcgtcaacgaaggaattgtgtcgagcaaagtcgagccaggctctgactggacaccacgctgcgcgatctcgactgcagcaatgctgaaaccgaagctgcgaattagagaatcggtatgtacaagatcttcattgccattcgcctcagaggtgttgttgaacatcgaattgatatggttcgccgtgagtgtgctcttgagccgcctgtagctctgaagcagttcggacacagggctgtccaagggactcgacacctgctgaagtgggctggaaggcgagaggtcttcggtgggagggaaaacaccgggcataggcatgcgcgctggcgtgatgtattgtgcaggggcagttgctgggaaaaagggggctctcagttggtcaatattactggaaagcgaagggaccagggtcttagacaagtagtcgataaagacgtcggtatacggttggggataggccttctccttctccataaggactgggaagtttcgctgttgattcaaggtgtgcttgaggcctgattgaatccactggtcgaatgattcggaggggctgagcgggacaagtggagactcttccttgcccttccaggtgatgggaaggaacgcattcccaagagccttgcagagaggacagacaaactctttgagatcagtgttctcgggatggtgacgtgcaacctgctgagagtgtcgccgctgtgtcgccgcaaagtactgctcaaaacaggagtaatgcattatgtgtccacagccagtagtcacaggcccaggaagagtactctttgcgttgaaccctttactcagtccaattttttcgctaataacttcaccaccagaggagtcaagacgcttgatggtagtatggttctctccggatacaccaaatggtcgcaattcttcggcggatctgtccagacttgtgggtgttctgagcacctcacgaattctatcggagtccctaatatccgtctgtcgcaggattgtgctttcatgaaccaaggcaaaggtaccgtagagcctcgaatcgctggtctcttcctggcacaagatacatgttccgctagggtacttccatagcttcttctctggggtggcgtctgtatcggactcgagatcgctgaaatcttcttcgccccaatcgatgttaccctgtctgtccaggaattgttgctgctgttgctggaactgcgccatcaccttggcttgcctctccaatgcttgcttcttcctgatctccttgtcattatccgcatcaattgcaggagagttggtgtcaattcggtcaaaggggaatttgagagacgcagttgccgatgaatacgtgcgagggcgcttttgccacagacgtttgagtatgtgtcggattttagggccagatgcagcgaattcagtcgtgacggaaattctctccaataaaccaacaatagtcaaatggccagccttgatctctcgagcctttgacaaagcattccagttgaaggaattggaatgctcttctaccatatcagtttcctcggaatcatcttctaacactgctgcaaggataagatgcagaatcacttgaaggaaagtctcaacacgggtcggtggaatagtcggtgtacactcttttgatgaaataacgtattccaaacattggtgaacaatctgtgcaaacagcatcgttccggcgaatcgggggagatcggagaacacgccggagctaacgggtcgaagtttcggctcaaaaacaatgtcagaggcattcttgcctgtctttttcgccatccattccctgtagatgttttctgcttcgtctctttggttctttgtatagtgtgcgctgtatggatcaataagatcaagatgttcgggcttcaattcgaaagtaccagaatcactcaagccctcgggtgggcggaagttggcgacatcttccaacacatcttggaacatgtccgagtccagaagcttgtcgctaaggcgggtcgaaaggtcagagaaagacagcggcttgaagcacaagacatgagcgatgtcacgtttgatgttttcgcgggtgagatgagtgctgtcatcaatggcagtcagagatgttcggtccgtcaggaggatcaccagtagatgaacaaattcctctgccacatccacgatctgggcatcttcgtatccaggacggggcatgtagttccgggccatccagtcaaccatgccaaagcggtgcgcaatggaagcaagaactctgctgggatcacaagtgactagggcagtctggagaaggaagatatctctgtagtaggcaaagtcacgagaagagactccacggtactgcgacatttgatgccgaaggctgagaccattgcgaacccacatgccagccttcatttgcgccagccaagcgcaaactcgaagtggatagtcaaacatggccaggagcaagtcctccggcccaagggcaagcaaaacatcatcaatactactagggtttgcattcttagcggcatggatctcactcctcgcgtcattggcagcggcaaagagaacctcgcgcatagtctcgctgcttatgtctcttccgcattcaacaagccatgacaacgtgtagtgaagggcgtggtggaaactgatagatccacgttccaccacgaattcaactacgcgatgacacgggacttggccagaagcgcctacctcgaaatcgaaaggtggcagcagcttgaatcttacttcatcctttatttctgcctggtcgaaccgcttgcgttctactccagttgaatggataatcgcagtagtagtggtggtctcgattgccctcagcaggttgccaccgttgtcaatttcagggttgcggaaagactcgcagaattggcggcaaagtcggttgatctcccgcatgagaatcgacgcactgatccaagcatccgtctcgtattcaacgtgttcaccaacagcgcggacattagggcaaataccctgtgacagcttgacgaggtcaaggaattggggaagatattgttcctcggtccgcacacggtgctgtacatactcagattggagaagatatcgcagatcaaggaagaagtggtagagacgtctgtttgtaaccgagccagcatcaaatgccagagtggcgttggggttgacggattgtggttcaccgacttgtctcgtggtcaagaaggtatataggatagacatcactttagtgaggaagttccctcgcacgacaatctcttccgtgatggagggagtggtgagaagctgcaatgaaaggttgacaatcgagtggtccggctctcggtccgcgatgaggtacagttgagccagagccgtgtacaatgcagacaaacgaagacccataatgcgcttgaactgaggaacattgacaacagtgctaatgtagagatcacgcaagtcggttcgtgtcttcttccacaacctcaagtcatagagcaccatccagtctaggcgagtacgctgccacaagtcttcatacggaggtactttttcacctggaccgggaatgggcggccgaacttgccagtggctgtctgtgttggaaggcctttgccggtgcgaaccaggagtcttggggatggggatatagccagtaggggcggattcaggacctggactctgagatgcagacgggtctcgttctgcagagggccgttctgcggtttgagccggtgccggtcgaggaggtggcggctgagtgcccgtcagtccggcgagaatgcgttctgctagagcaagttcgtcatctgcacctgccaagaccatatcatcatcttcatcctggtcacgagagagttcgatgtccatttcatcgtcatcttcatcatccgcatcgtgtgcctcgacgtagtcttcgtcttcatcttcgtctataccatcttcatcaagcatgtcgtcttcgtcttcgttggcggtcaagatcacctgaccatggttaggcaaattgatcatgagcgtacgacctggaagactttcagcccgctggtggtcgtcaatgcccttcatgccaatatcttcgttatatcccccactgcccttcttccagggcgtaagcatctcctcacagatgatttgtctgaaaatctcattgtcctcgaggatttcacagccggcaatatcagccaaccactccactatcgttgtgcacatttgctcgcggaaagtgtcgcgcgcagagcgcaccgtgacagtaaccttgatctcctcaatgattttagaaacacctaagagcctgttcaggtccttcgaatactttatcacactgcggcccatatcgtttgtttcatgagcccgcgcaaggccaaagctatctcgttcgcgacaagcacgggtgacctggtgagaaacatcgcgaattgtatgcttctcgtcattccacagcatgaccgcgaattccggttcttcttcctcttcgtcgccagcgccataccagtccggacgcaaccgagaggcctcctcatcttgcctgatgccctcgacagtcttcggcagccgcaattgctccggggagcaagagataacatcgcagaagtagtcgagtgcacgggatatagtcaagcggattgaatccacaagttcagaaggcaatggccgctgcgcccgtttacccttggcattaccactatcggtatggattgcgcaaaacagcggaaggcgccatgcttcgtcatcaccacaatcacagcagccacagtttccggaggaaagcgaaatctgatattgatgtccggtgtgatccgatgagtcgaaacatcgactgcacaacacgcacgtatcatccgcggcacaggtcacgcatcggtatgtggcttccccagcacggaagatatgaccgcagcgcttgcccctcgctgcctcgctgtattcagctccttcccgggcaccttgagcctccgccagtttccatggcccggccggagttccttctgggaacagctgttgtagcagatctgtgttgtgtccgacaagcgatcggaaaagaagctctagcaggtccttctcggcagcgggcccatagcggaaattgtgtttcttgggcaaacggagaagaccatcaccgagcagcttctcacattccccgagcatgagcatgatttgtcgttgtggccgagctatcgtagcggccgctcgggctatcacaagtgggtgatggaatggagcgccgttgtcgcgacaatgcgctcaaggtagtaatggtccgacgcaggtggtttcttcgcgggtatgcaggcggaaaagaaattttcaagggagagttcaggcgatcggtccggatctcgtcgataaggttctcagatgtagttcacgttgctcacacactaatactttgtagtggggggaaggtgagagcaacgggtgaaggtggaccaatgcaggcgaacagatcagcacagagacggtgaagtcatacgcggttaaaatttgaatgtggagctcaaggtccaaaaggacaaaaaaaaaagggatacaagaaatcaaattagggatcgtttgtagagaccggaaggtaacatatttcgctatgacatcgatgggaccggtctctcagtaaacgccacatccatggcctgactacccacaggaaacacgccacattttgaacatttgaagttataaagaccaatacagccgcttatggggcctcttcccagatgtatttgatgatgagacactttaataatctgatctatttgcctcaagcatgatcttagctttatatgcaagaacactccgtgtgtttttgatgtatacgaaggcggtaaaacgcataaaccatgcagaggaccagaaggattgcaagtcaaaatacagatttccatctatcacgtacaagcccacatatgggatgagaaacaacaggcatgagcttcgctggcttttccatgcccccttacccgctgtagggtatacccaacatcactttcggcaagtctatttactcgtcgtcctcctcctccttaaccatataacggtgcttgatgtccttccattggcgctgtagggtgagagagaaatagtcagcgtgggtcctagcctcgggtattgtagacggtccatcgggaaagaggttcacatacgccctggttccagctgtcccagaccttgttggaggtgatgtcgaaggcactgttttgacatttcatggtcagtcttccgcattaagggtgcgacatgtctagcatgctcggagattcgatataacccacagctcgaaagcaaaggcgccggcaaaagcggtggtcaggagaacagtgttcttgcggatgaaggtcctaaacacagagaataatgcctcggttagatttcaattggacaatttcgatcgcgatcgtaggacctaggaaggggagacatgcgagtagataacgtttgcgagctgtcatgcgagaggtcagtcagtactggacatagcagtggaaatagaggatatgggagagggagtatagacatacgccagccattgtgagggattggggtgttttcacacgacctaaatcaaaggattggactgaaggatggggcaacgagaggtgaagttgtgaggttgaagttgcgaaggctgaatctgcgggaattgccggtacgctgattggccgagcctccggccttccgcactcaactttcgatgttcgcgttgtttttctctttcgatctttaaagctattgctctctgccttggagcttgactctgtcaagttgctatcagatatttctcattttacaatttcattacccgaatttgaccctccacaccacaccatggcctccaacgtcgccaggtccggcatcaccaccaatgctcaaaccggcgaacgatacattccctcctcagtccgtgccgacggttctaagcgcaaagagatccgcgtgcgccctggctacaagcctcccgaggacgtcgaactatacaaaaaccgggctgcggcagcatggaagaaccgcggaaaaggcggggtgccgggtgcggaaaccttgagtagtgaagacgataaaaccaagatcgcagcaaaacctacaatcaccgccaccactgccgccagcaacaagaacgccaaacgccgcgaagccaaacgaaatgcgaaggaaactgacgaagccggccccaccgctgagggcaagggcgcagagtcaaacaattggcgtgccccggcacccgcacctaaggaagaaaagcctactgaagagccgattgatctcgaagctgagaaggagaagaaagcacgcggtctgaagaagaaactccgccaggcgcgggatcttcgcgacaagaagcagcagggagaggccctgttgcctgagcagttggagaaggtcatcaagattcaggaacttgtgcggcagctggatgtgttgggctttgattccaatggtgataagaagaatggtgaaagcaatgagattccttgagtgcctttttgaaccttaaacgcggggtaagatcagattcaataccccatgcccatgtgttgagtatgtgcccatatgcatataatcatcaccagggctacctgcaaccaccatgggagtccgtcgggggctatcaggctatcctacatcattgtgacacgtgatgggaagtgtgatgtgggataccttcatggcaggatagattgccgccaatcggttccagccttccagtcacccatcgcttcgactgcgagagattcaggctgctgccacatctatccggttccctcaatcgggagtcctggtgctcccccgcccttgatcctgaattgagatctgagaactgaggagagtaacagacttcataaatggattaaatccaacattctgttgaccgaacatgggctggaattggattagacattaggaagtgaacaccttaaacgtttggtatcctgctaatgccgtcgatctccaactttcaacaagaaaaatatatattacaataatacatttaatatacatggcttagaccttcgtgtacattcccagacacaagtagaaaaccacatgatccagtcacatggtatcagatttcggagtcaacaagacgaacaggagacgtcacaatgccaccccggaggttccaacgttcataatcaaaggaagtccatggacgccacggactaggctcatcattgagcgggattcttccaatgccgtaggtggcagataggataccctgtttgacacagtcgcccacacttacgccattataccagtttcccgcgagaatgagccgcttgctgtactccttgcgaactgtgtgcgagagcttatacatacggtccagatggccgactgtgtactgaggaatagcatccttctggagacgactccgcgcgacagtcggagtatcggtgatattcatgtgtctcttgagcatgtcgcgggccattttcactgcagtgtcgtggtctggatactcttcgaaaccatcccagtaatgtccacctagcatgacggtgagtttcgttccaggtgcagaatcttggctgacttcagatgatgaagggtccgctccgttccctacactagaggacgaggcgaagatgacaccaagtccacattctgggttctgcttgtaggggatcgaacgcggtatgaggtatccaaagccatcctccacgggtagaaggttgggatttgggtaatagagattaacgaccattaccgtcacggcgtagttctgtttgcgtaatagagatggggttaagccgacggggatcatctcggcatgtgactgttcgggtttgcgcatgatgttcgcaagtgaaactggagggatagtggagatgacatatcgatagtcaaatgtcttgatttgattgtgcctgtgtgaccaatattccatctattgacagtcagcatcaatctcagggtccagggagttcagggacatagcatggcaatgcagaataattcacatacagcaatggcagcagtagactctttactcaaagctttgatctctgtgttcaatcggaggtcgactttgccggatgctttcaatgaagcaatcagtgcttgaataagctggccgactcccctcttaaaggtgaaggtactagctccagccgcaaggacttctaaatcatgctgacggcgcactaattcggggcctgcgggcatggcgtctatggccatgaaatcatccatattccgagttctcgttttagagattgacctggagataagagatgccgtaactccaccagaaaccaacccaccgatgcccccaatgcctccctcaaggttgcgaatgctacccaatagtgcttgggcactcaatcgatcgatatcaccagcatagattccatggtacacagcagagactagattatctgcaacattggggccaaaacgacgtctgatgaagtcggcaacagattcatccttcgcccattcggttgggtgccggggcggagtgaagacatccttcgctatccccgagagaaatttgttaaatagcggctcttgcatagtatccataaagatttgcaagttttccccaaaagagagttcaggctttggcgccggcatacgaacgagacggtccgggtagtaaatgtaacgatttcgggccgcggggctcgtgttgggggtaacaatgaggtcgtcgtacaagcctagatttgtagccttttaatagggtcagcatatgaaagcttttcgattctgagtatgcgcacacgagcaatactcaccaggtaaagcagagggagtgatcctggcagcgagctctttaaggtccgcggcccatactcaaacacgacattgccaccatcaacaggaactgtttcagaatttatccaaccaccgagccggtccgttttctcgaacaagatgacctgtttgcatgtagggtcttgcgcgagttgccaggcggctgtgagtccagtgatgccaccaccaagaacggcggcagtgtatgcgcgtttctgatcattgagatgaatcaattgcgttcgtcttggtcttactgctctagagacacatggtagcaacatctctgctgatctgagcaacgttggtggtgggataattaaagctaaacccgaaggtcctcgggagcttccgtccttacttaagctacgcgggcagcctccagggctggtctgcctacagcaatcctacgcttgcacagtggttcgtgagacattcgcgaattcatcttcgcttcggtattattcttttgaaggtcaacgggggaatctatgaacagaccagataatagtatctgaaacaaaagcaaatgcataaagagtatcaacgccattccctccagccattcctcgttcattgatcaagatcggattgtacatagtattcttcgcttcagaaacagactgttgtgggacgtgtgtttttttttcgacttttcttcattgtcagtcatgtcaggcggagtcacgcagtcagctcctggctttggctctgagtgttctcctcggtctccggtttgattaactcttgcggtccatccacatccgtgacaaacttgcgctcgctgacatgctccccagagtgcggagtccacaccttgtcggtgtaagcaccgcgctggccctcggtgtgcttataggggcacttggggttcaggcagggattaaacttgcaggcggtctcgacatgtgtaaacttgcatccttcagtcttgcagtcggctccattgcggcagactggcatactcgggtgcttgaagggacaggtggggttggtacagtgaggaaagaaccgacacatggcctctgcctggtgagcggatcgcactgctggtgaagggtggcgcccggtgcatttcttgttcttgcaagcagcaccgaatgagcaagtgtcggaaggatcgattgaagtaccttcgggggcggcaggtgattgatgggcaaacgggcaatcctgtcgcgagcatcgttggttgaagcgacacacagtgtcggggttgctttcatcttgttcaccacccgttgtgctgtccatgtccacatctgctccttctgccgctctcggtttgttgtatccgcgctttcctccacgctggccacctcgctcgacccgattgaagagcgaacgaccctgagggccattctgggaaccagtctggaaagcggggttgacagcgggtggcatgaagccaggcatgaattgcgacatcatgcgagcttgttcctccaacatcgacataagctgcatctggttttcgggggtcatctgcatcatggggttgccttgcattcccatggcacggccaccgcgaccattttgttgtccgcctctcatttgaccccggccgttgtgaccgatgcgcccgtttccttgtccccgcacacggtgcagagctgcatccgagccacggtctaggtttcgattgatttggttcaacatccttcccttgccgcctctgccgttgcgcatcgctttcggtcctgtggggctattgaggagcactgtcagcatgttataggcattagcagaaaggcatggtaaaacctacatctcgtttccggcctccgccatctcggcatcctggccgttggcctctccgaacggattgggcgtcgtttgagctgagttgtcgaattccatggccgaagggttcagctggcccatggtggtgtcgttcgaggctggagcagccccgttgatttgttggttgagcaactcgacttgagtgaaaagccattgtgaaaactcgagggccgcagtgtcaccttcctggaggccaagaaaatcatttgaaagctcggtggctatttgctcttcagtcttgccgttgaccagcatgagaacgatgtattcgatcagtggtgactcttggccatcactccaacccatctccaccaatttcggctggatgacatttgcgactgctcgcgcaagaggcgtttccaaggtgatttgaggcagcatggcgaaggcgattgtagagtcagggaaaagtgaaaggttggtgagaaattcacaaagagggagcagtgctgataaaagaacttgcgccacccgataaaggcgtttcggatcttatcggcgcgactaacaatgaagatgcgattaaaacggtaggcgatggcagttgaggttagaggtgagttttaatagaccagtaacaggttctggtagagaaagcaaaactttagcaagcagattgaagtgaagctaaagacccgacgaccaaaacggatgtttgatcacgtggctgtggctggccggcggtgaggtggggcagaacatacaatgcaaataaccacaaggttgatttggctattaatgaagagaaggtcttgctttgatcgaactgtgttgcaatagtcagatgaaagagagaagaaatctgacttgttgaaaatcataaggaatggaccttgcaactactgaagtttgggtttatatattcacaatggctattgttccgccaccaagatgttgagttggttgttgtgaatggggctaaatgggttctatatacaaagagagtatccagacaaagagactcacggtcaagtgacgtctaagaaaggaatagcaattgtcccaaggcttctaggtccgtagcctgaggcatggatatattatacctgaaatatcaggcatatgacactgcctcaggccttgatgaaaagcatgtacgcataactatgtagtttagcggcgtagggacgtttatgtggttgcaggccacctatccacaaagcgctgtcgatctccccgctcggaatcatatgccatcaacccctgtctgccgaggtgtcatgtcttcaccatggggcatcttccccagatcgtcggtgcccccacaataattatacggtgtgaaaccgagaccacaactgaacgctgtggggatctgtgcctaggccaaccccatattgcaatatcaaatcaacgagggatcaatgaacaaaggatgaagtcacataatgcggggttcgcaagcacggctcctttaggccatcctctacacctatttggggcatgaggaacacacatcattggatactaaatgttcagaggtattctctgaaaactagtgtggttgtgtccccagattgataaacgctgcaacccgtatggttcatactgtttgacaagttcgtcttcatgactagccttccctgccgtatgttatccaacataccagtcctttttctcttattctgaacgcgccctccaagacagaagccagactaaacctaacttggtatagtctaacggcgctatgattgaagacctcctggccgggacgacattcagtcgggcctcagtattgcttctaggactattcgttgcattctgcgtgttccggaagttccaagcttcagcacaaatcgcccgtctcggtgtcagagctcccaaaattgggttccggctcccatacgctctcgattttattttccaaggttaccaagccaatcaagtgaaccgcgatatagagttctgggatacaaaagtcggccaagcagggggcctaaacaatgtgaagacagccgaattggacgctggcatttccacccgtatggtcatcaccaaggacccagaaaatatcaaggcagtcctcaccggtcagttcgccgactacggtaagggtgaaacctttcaccaggagtggaaggagttccttggcgacagcatctttaccacagacggcgaactatggtctcgctcccgtcagctcatccgtcccatgttcgtgcgtgatcgcattgtcgacacggaaatcttcgagaagcatgttcagaaactcatcccgcttcttggcggcagccactcacccagcagcagcaaggtagtggacgtcggatcactcttcttccggtataccctcgatgcagcaacggactacctgctcggccagggcacagacagtcttgataacccggcaacacgcttcgctaaagcgtttagatatgtgcaacagcgccaagcggagtacttccgtttcgggtgagtgatgagactcgatcctgtgcgacgcaagcacaagctttcattggagctcgcagaacctaatctaacaaaccctaaacagagtctttagctacttcatgtcacgcacggaattccgcaagaacctcaagatcatggacgagtttattcagccatacatccagaccgttctcgcccactcacccgacgaactcaatgagaagctctcaaagcacgagaccttcctcgatgccctagccagctttacccgtgatccccgcgtcctccgtgaccaacttgtcgccgtcctcctcgcaggccgcgacacaacagccgccacactatcattctgcctcttcgagctgtcgcggaacccagaagttgtcgccaagttgcgcgacgagatccgcaatagacttagcgtcggcgccaacgcccagaaacccagctacacggatctcaaggagatgaagtatctcaacgcagtgttgcacgagacgatgcgtttgtatccagtcgtgcccttcaacgtacgctattctttgcacgatacgacgcttccacgtggcggtgggccggatgggctagcgcctgtgggtgtgcgtgcaaactcgcgggttgtctactcgacgatgttgatgcagcgggatcctgatctgtatgacggccctggatcgaagaactacttcgatcctgggaagtggattcctgagaggtgggtttccggctggcagccccgaccgtggcatttcattccgtttaatggtggaccgcggatctgtattgggcagcaatttgctattattgagatggggtacacagttattcggattttgcaggcttatgagcgcattattgcgctgccggtgggtgggaaagacaaagttgaagatccggtgcttcggtttgaagttactctcagtcctggctccgagttgaattgcgttttcctcaaggagggcgaagaggctgtgcgtagtggcgctaaggcaagagttgcttgaggtatggttgattcttcgaactacagtatgatatgatatcttttgagacatgagtttatgccctactgttagcttttcgaacaaggtggaattcatattctcgcattcttagtatcccgtaggtagatctaagtggaaatataccctcgcaaaaaatccctaagagccctacaataaggcaccattataaatttctgacgcatccatgcagtttgtagtagattttaatttgctttgcagatcttcccaggctttgtgcttttgtctcctttgtcccatgaagctatttagataggctccgtggcaccagatagagatcatcatcagcatatatgctattgagtcttctgttgatcacctctttcttctcttcgtagatctgtggacactgactccatcaattccaaatcctgacataactacgtgtataggaagaatgccttcaataacaagtcgttgtcagtactagtcctggcaacagcagacacggttttactcgtcatataaattcattcagaacacccaaacgaacgaagatgtatgtacagaatcgatttctcttactatagcactttttggccaacgacaacatatacggcggtttggccgagtggtctaaggcgattgactagaacgttcttgagatcaagttaaatcttgaaatcaagtatccttaatcaattccgttcgcgggcgcatgttcgaatcatgcagccgtcgtaagctttttgcttcactagcctagtgtggcgagacatctatagaactaagaagattggaataggaagaaggcggatctgatttttaccatacctactaactaccttcctacctatgtatctatgtataattatgtttgatttagatatttaataactatagcacgacatagttatgagttgttacctagatagttaaattctatgccctaacaaaagggaaaatttgcgtttaggcgttaaccgattcggggttagtgtgtttacttggcacttggcaaaaccacatcaggaaatccacactatgcctttgtcacatatattaagggtgtgtctagcaagcaaaaatttgacgacggctgcatgattcgaacatgcgcccgcgaacggaattgattaaggatacttgatttcatttagcttgatctcaagaacgttctagtcaatcgccttagaccactcggccaaaccgccgtaatgagaaaaggttttctagattttgcatcgcgaggaagactgtacaggtcatcttcttgggaaataagaatacaattagtaggagtttgactgtcgcttccgtagcttcctcagtctttgcaaaatctccactttccgcagctccatgaacaaatcctcttcatctgcatcatccaaatcacatagcacactccccagacccgtccgtacagttgggtatgtggcttcgatctcctttactgagacatgagctctctctttgacagcggcaatgtatgttgagcttttaaccacatctgagatcaaagaagtatccgagatctgcaatcctttagacggaggtagaccagaatccttcgccggtgcatatgtgccgtttttgggactagcgacctctttttgctctttttgctctgtgctcttagatcccacccagcctctactcatctgcacagccttttcccattgtccgaatttagcaacactctcttgtcgcgggacttggggctcgaagaccacaccgccagaacgattgatgtcgcgtagctcggcaaagttgtgccacagtccagcagcaaggcctgctgcaattgctgcgccgagagctgtagtttcacgcatcttggggcggtagaccgggatagatatcaggtctgcttgagtctatattttagatgagattaattcttgtccaaaattcatcgaggtataaggtaagaaggcgtcgataggttcttacctgcattgccaagtctgagttgctcatacccccatctacagccagttcggagagtgcatggccgctgtctttctccattgcgtctaggatggctttagtctggaagcaggttgcctctagagtagcacgtgcgatatggcccttttgggtgtattgggtgatcccaactgcacactgtcagatagaatacaacagtcaggtgatgagaagagaaactcacagattgtaccttttgcgtcatcaatccaataaggtgcgaaaagtccactgaaggcagtgacaaatacacatccaccactgtcttccaccgagtaggcaagttcattgacctccttagactcctggaagaaattcaagttgttctgcaagaatttgatcccagacccagctacagcaatgcttccctcctgtgcatagataggcttcccaccaaagtggtaagccaccgtagccagtaatccatgtgtcgagaacacgggcttgtcaccaacattgtacagaagaaagcaaccagtgccataagtgtttttcgccattccaggcgagaaccctttctgcccaaccaacgccgcagactgatcacccagacatcccataatcggaacccgtgccaacgccccagaagcaacaaccccatacgccgtcgcatcagacgagggcacaatcctaggcaaatgaaccttccccctaatcccaaaaaagtccagaagcgtctgatcgtactgcaacgtctccaggttcacaaacatggtccgcgaagcgtttgtcgaatccgagacaaagacgttggcagccacgccaccgttcaaacggtagaccagccaagcatcgacggtaccaaacgccagcgtgccgcggtcaaatgcatccttcactctggggacatgcgccaacatccagagcagcttcgtagccgacgagtaggttgacagcggcagaccgcagagagtctggagctgcgcagcccctggtttctgtttcagttctgcaacgatcgcctgggagcgtgtgtctgtccatacaatggcattgtacaggggctcgccggtctcgtggtcccagactatggttgtttcgcgctggttggttattccgacgctctggatgctgcttcgggtgtggccttgtgtttcgaagttccggacggcttcctcgatgcaggtctctactgaggttacgatctcgagagggtcatgctcgtgccaactagaagtgattaatttgggttaattctgcatcctaggtgggctttctggctattggactggactgggacttaccccgggttcgggtagatttggctgaactcgacttgatgtgatgctactgggtcgccgtcgcggttgaagatcaaaaacctggtgctcgttgtgccttgatcgatcgatcccacaaaggtatctgagggctgcatggttatggatagaggaatctacggaggaaaacaaatcgagtttggctatttgcgcatgacatgagatgtcaaaccttgcgatacaaaggaagaactcgagatacagcagaccccaaatacataagtaaaagactttcctggataataacttcacggtcacacagcggggtgctcatggaatgaggggaagacaccgagagaagggattggtgggattatcccttggccagacgtgagatgagaagtgagaacgggctgtgcggcgacatgtattggcccttcgtatagactcttcttggggttcttggaacttgaagtggaattagccaagtgtcagtgcactttggactcattagggaaacgatatccccatccccaggaaaatggttccctcgttccgacttcccccaaaccccagtatgacctccgtgcatattgtggagagagatcagcagacgattgacgactcggttgatttggcgaagtgtcagattcaacttggtggggaattgcgcactgactcggtctttattccattgtcatattaaaccacacgaacatctatagatggcccaaattgcaacggttaggccggcattgaaattttatctgcaagcctatattggcttttttttcccacggtgaatactgcggtgctaacaagtgataactaggggacatctctatctacgacactcgcagagtcaaatccggacaaccccggtctcggtgatactacctctaagcatatggtcacacagttaacggtcaattgtgtcactacggacgagaaatggaaaaaagcaagaaaatactaccctcagtatcatcattatcgggaaagaccaatctctttccgctctcgcctccttttggagaagcctgccgcttccaggtgacacagtttggactttctagaaaattacaattgggcctgcgtgaggtctggcacccgacgagttgatgagtaacagaaggcagacaagcttctactacagtcatgacagaggcaaataccggtaagcgggaactatacacaacattgcggtgtccaaaaagtaccctaaagaacacccaacaacacccaaccgggatcggacagtgacttccggctgcccaggccaaacggcccttcctacaaacgacccctgaaataaactatgagcagaggtgcgctgtcagaaaattctactctgcgtgaaagggaaacaaaaaaaaagaaaaagaaaagaaaacacggcaacaaaaggcacaatggccagcccagccagttcaataaaagggatatgtgcacttgatgattccgagtctatccggatttgacttcagctgatatctttcctgcaagcttgaacgccctctggagctctggagcttggaaccaggaggacaagagacacacagacacactctcttccaggacaagaccctgcatcagccaatggaaccaccgtcttgtacgaaggacagcacagattgagagcaaagggttggttacacggtcgttcctggttcttcgttgttgctataccggaagaactaccttatcattcttgtgttggcgagattccccccggttggtcgtactatatcaactcgaagccccaaccctggctcccggggcttaggttctcccttcgatggccacctggaaagagcttgagcttgattcaatgtcaaaagtacaccgtgaaactctctcctccgatactcatgacagcggctgtggctcgctgtgtctgacggacaagaacgaaacggctatccaccatatcaaccctgaagtcgaaagcccttatactcgccccctggtgtggtttaaagtgcgggagtactgccatgaagcgttctcagagttctttgggacgatgatcctgattttatttggggacggggtcgttgctcaggtcctactcagtcatggtcagaagggtgactaccaatctatttcttggggatgggggtaaggctcttctcctttatcgatcacaattccatacgctgttctaaccgatctcatttaacagactgggcgtcatgctcggagtatacgccagcggggcatcaggaggccacatcaaccccgccgtgacatttgcaaactgcgtcctccgcggcttcccctggcgcaaattcccggtgtacgcactagcccaggtcctcggtgcaatgtgcggtgcggccattgtgtacggcaactataagtcagccatcaacgtctacgagggcgggccaaatatccgcacagtccccggctactcgatgacggcaacaggcggcatcttctgcacctacccagcagaattcatgacaaaagcaggtcaattcttctcggagttccttgccagtgcggtcttgatgttcatgatatttgctctgaaagatgacggcaatctaggcgccggggcgctgacacctctggcgctattcttcgttgtctttggaattggcgcgtgctttggatgggagactggatatgctattaacttggcacgggactttgggcctcggctgacctcctacatgattggatatgggcatgaagtatgggctgcgggggactactacttctgggtatgtttgtctgaacatcacatggaccaaactttggggacttgcccggcttacggatgttttcctattagattcccatggttgcaccaatattaggttgcacattcggggggttgctatacgatctattcctgtatactgggatggatagcccaatcaacacgccctggatgggaatcaagacgctgtgtgggcccttcggtcgaaggcgagtcgcattgcagagtccagtctgaaacaatcctatccttgctcattatatccgcaatgtaggcgtggagtggtgagtactgtacttgatttgtgttgctttatcttatttatgatctgtctatgacaactacgtgtgtaaaaaggggtggaacttagcgatgactgttatgatctgtattttgcactatttagccagtttctgcagcgttcttttagcatcatggaatctactttaagttcttcaacacagtccatggacttcagtattttctctcctatttaagccagatgtcttgtccgggccaagtattcgtcggctacgtctataagtcatggggtctataagagatataacagccagtcattggcacaaccattgtattgtgtacatttctctacacgaagaaaaatgcatccaatgtatgaagggcatgcagggcgtcatccctctctatctcgactgcatgattccagaagggaacacagcatctgcagctaacttacttttcaactggctgttctagtaactcaatcatcgcacgcatccaacatagatagagccctaaagggagtatggttaaaaccatgtcctgaacttggttagctctcgatggcctattggtgcaactacggggtattgattggtgactggcatgtctataacaccttaactattccggaaattataataaacttctattactactcgatccggctttagacgatattctagtattccgataaatagaacggtttataaggaataagtatctcccccgataagcctctcctatactctacgctactcctataggttaaaataattagagtcattaactactagattttttcgataagttactcgcccttatagcttacggtatgcacaatctctgggggccgaacatagtacgcttcccagtcatcgactgtcgcgccctcaaaggaggggtcttccaagaccgttggggtgaatgtgtcgaggagatcaaggccattataaaactcaaggtatcctggggcggcgctcacgaagtgatccataaaattctgccggtcagtattgttttggtatgtgcatcgatagatcacaaagccccattttttgaatccgtcctcgtcaaggggcttctcacgccggtccgccgcataccgaccggcatccattgtgggatcatgtttcgaggggaccattgttgaaagtgtggtaggagtatccccgaaatgtggtggtataaacgcgggcttcgcgagacgcgaaaaagcggctaatgggagcagaagagcggacaatactcgggcggctggaaagggcagatttgctgtagaagcgggtggacacagagcgtggaaaacgtgtagttcgaaggaattttcttgtaatcatatctaggtacatatgtaggtgtgaaggcccctgttttgtcatgaggcgacgagaggtacgagtgggaaaaaaggcggggtgatttgctctccaagttgagcaatgtcatgcaaggaagaaatatactagaatgaaacgaaaaagaaaaagaacgaatattgtcgcggtgaaaagaaggacagggtcagaacggactggagcatcaatgcacccgacttggagaaacccttttacgggagatgcagacaccccctcaatccatgaacatcagatatctttggcatttctcccctccagattttcctcccgaatctcattacgtgatttatctcttccagacgcggtgacgctttctctgggcttttattggacctgtacatgtgaagaggtagcaagcccctggcagttccgagccttgaaggtccactatacaacctgagccattgtcaatgttctcgttctcacaaatggacactaacccgaagccttttcgtgatctgctcgaccatcatcgtgatctttttgtagatccactcttatggacttatcgccaccttaaactagtgggttgtcgatttgaggacgccgacacggccagcacagaatcaacccaggacgactgcaagaccgacgatgacgaaaggccttgcccaaaggtacccagcgatgctgagcagcttgcaacataccccattgctgccgtaaagtatcgctgccttgtcaacattcttgtcgggaagggacgcccatttaaaacacttcggtaagatatcgcgtgaaatacaatgtctaacaagtacacaaaaagtgactgataatttcgctgagcagcaaaggacctcaattctacttcacagacaaacctgtccatcggccaagacatactgtgttctatcgccaaggacagtcggacgcacattttggcaaaggcttgtttccgttggttagctacctgcactatacaagtgtcaacggaggccgtagagacaaattcgagccttgtccaggccccaagggaactctcaattggatcggtcaacgtatcctcgaaaaacgactggctcaaatccaaccgaaggaatggacagaggatccatatttcgtgtgtatcttgctagctcttgcacaactccaagagcgcaaggttgagtttccgaagccagcaacttacacggtatgtctatcttcaatcaggcttgttcttctttcctcgggaactctaacttttcggcatctagtcgcgtcttcttgtaaccaacctgtgcgacaaggaatacatccatctttacgaggctgaaatctccgctgaacttcttggggcgctcagaagcccgacaactgccaccaaatatacaaaatggcctactattcgacgaaggaaactcccatacaagccttacaacacctttgcggaccgcatcacggctgagctagtggctcctagtctcctgtgctcgcctgagatctcgagtctgtctgatgaagtgaatggtgtcgttagatgcggcacgaaacgaccgtccgagccagaaagcaataagacatacaagacggaacgaataacataaaccagtgatagtccatcaaatcagactatggcccgcaagtccaggtcagcaagtctaggaagattgtatgctttcaaccaggctgccggatgatattgaccctcatatttgtactaccacgatgccacgcttgatcttctctttctgcaccactatttgtcgaatacattttaattcatctagatatgatactatggagctaaccttctatgtacatagtactaaatatgtaggtggtattgaaccggatcaattcaaaccccgatataccgagtctagtctgtacccatgtcctctaaaaccagaaacagaagatattttgctgcagatcgtgataggagtaatactaggctctgttcttcttcccaacacccaaaacacaacctcgattccagcaacatctatcccaagccttgcccagcctacagagcctttcaggatccacaatggacttggaaaaacgccccgaccactcgcagatattgaatcaacaaatacgggcgaaggatgaccctcgcccccgtcaagtcccatggctggagcgctttctggaaaggattgggttctttaatcacaagtacaatatcatgtacgagccctatataactcttattttgcattaccggtcgctaatttcatactggctaggtatatgttatgcgttggcctatgtccgtatctatttgaatacctcgtctgccgtcaatactgtgatagagaggattgccgcttttaccgcaataccgcgtcacgctgtacagacatcttgctatttctttaccttctccgcattcagtacttaacctggtctcgggataggcgagaagacgggcgacgaggattgccgctgtgggctgtggtcctatacattgctatgacaggcagaagattgctatttacccctgtttcatagttgagtaaggaaatgtatgcatttattattccttaaccattagctgggaaacatgtcatcgcccgtatgagaagtgaaagaagccgaaagaaccgaaatggcagtgttgcgtccaactagacctagcgaaaggggacaaatgaatcgccaaattatatcttggtatttagcagattcatgaaataatatgtagtgggagtttgagattaaacggagctgaggcgcattagatattgaaatctagtccttccaaaagctcctgttgaacagtgtgaaatgaaaagcttagatgctgtgtacatggctaaaacaacacaagactgtagtggtgttatcgactcagaactggtactatatacttcaaacggtggaagatgatgtggattttggaaggtaatctcaccttgtaaagtccataagacataccagctctcacaatcagaagtagtgaccaagttcatatacatgcttgcaggatctacggatagtgctacaaggcaggtaactctctacagaaaaacatgcacaattcagaaccgatatcaatgctgctaggagtatgatgcagatacacacagcgaaggcacgcaacgaacatggacacctatctcacataaatggaaacaacagatccgattcgactaacccgcaaggctaggatagaaaatgcaatgcacacctttaccgcttgcccttcttacggggagcgacaaccttgaacgcagagctggcagcctcttcctcgcgttgagcagcagctgcaacggtagcagcggagcccttcttggcaacctcgctccagccaccgccgttcttctgctctccgaaagcactgggcgagacagggtccacaatgcccttatcggcaagcttgcggcggcggatgaattcctccgcgaagcggcggccgtccagagtctgggagttggcgtagacggagtcggagatgatctcggcctcggcgggcaggaagagcaattgctgaacgaaatcgtcgactagaggcgggatgttagtacggaaactatgtgaattaaattgaagacaacgaaacttaccattgatgctgctgttcaaccctttgctcagagccagagtagcccacttggtgaactcctcaacagcctggttggggttggactgcggggtgctgccgctggtcacggtacgggtagtggcgacagggcggggcttggagataagaggcgaaactgggacggttccgctggctgtgcggggtcccaggggcggcgcagttggtgcgcccttgaccttgccactggcaccgacggtggtccaggcgctggatccctggctagcgggggcggagggagcagggcccttgctagcaagatcggcatagcgctttccggcagaggagggcacgggagggcttggggtcgcagccatggcggcggcggcagcagcagccgcgcggttcttgcgggcttcctcttccttctggatctgagcaagagtcttcttggcgccagtagcggccggtgtgggctgggtcttggtggcccaaggggagccggtcgaggcaggggtggccggagatccagcgctagcccagttcgctgacgagggaaggccaggggctgcctgtgcctgtgcttggctgagacgctcttgctccgcgaggaattgagcacggcgtgccgcagcggcgacttcctcacgttgggcggccgtacgagcctcggcttcctggatctccttgagagaggggcccttgggcaagtcatttgcctccttggcccatggtgcgacagaggtaggcgcagcgtcgacgggagtctgagtctgggagcgggagccagtggccagagactcggcgacgttttggcggttacgctgggcggtgggtgcagggagaggcgacgcggagggtgggggagggaaaggctggggcatggcgtgatcaaccttgtttccccagaccgattcagaagggccatggctctgttcctgttcctgctgctggcgttgagcagaagcagccttgtgaacttgctgggacagagtaagaggctcagaaccagtaacagagtcggtcaactgttgagctgcctcctccatctcggctgcaacctcggcttcgagttgctgagatgcagcggcagggtgggtaggcagaccttcggcggtgcgcatgcccatctccccttcttgggcacgaagagcatggaattggcgaagacgctcctcgcgagcgtgctgatcaaatggatcatcttcatgggccttgtcgaagtcttcctgctcttgctgaagctgagcacgatcctgaagcatttgactaacctgctgggactgcaagaagttatcaggctgacggccggagaatgaaccagcactaccaaaggcaaacggatcctggcggccgacgttcaggcgatcaagtagagcggggagttgatcctggctgccgaaatccgttcccagcattccaggtcctacgttcaaaccgccctgtctcggtgcaacaccatcgaagaatccagggacgccttgggactgctgctgcatgggagcctggatcggagatggctggtagccaacgggtgaagtaatgcttgagaagctaggctggctttgaaggctatgcgcgctagactgatgctgcagcggtgggttcatggaggatgagggagcaccaggaggagccatttgcttcataatggcctgctgctgggccaggtgctccttctgtcgagccatcaggtactgttcttcctgcttgcgtcgctcgagcgcattctgctgctcggctgttaaggtagtgccaaagcttgggaaactacccgggaagggaggctgagcagatccagcggtcgtgttagtccactgggcgacagtcggttctgggccatgtggaaggccaatctggggcacaaggaatggctcgcgtgagttcccaatgcgtctcactagctgagctagcggctcaaactcggtgtcctcaagcttcttgatttgcaagtctgggctgaagaagcctgccttgaaccaatcgtgcatttcgagtccagtccacgggccttggatattgccttgcggatcccggtagatccaacgcatcctatccggcatgaccatggtacgctgctgagaagcagggatgcctgcgccaggggtttgactagaaggaatatcatgaccagccaggtttggaatagagccaacggccgagacgggtgtttgcgaagcaggcgttgagccaggatggcttgcctgacccgccttgtccccttgcgaggggtcgagtccatctaggcccacagaatcgggtctgccttgctcgtcctgcatggaagagaagagggcaccgagtttgcttgatcggccgatgcttccagaaccagtcataccggcatgggggctgaatagaccacctccaccgagagttgacaagctaggagactgaagatcgcccatagagccaaagatcgggtcaccgaaaccgccaacaaatgcggaacgctcacgagtgggcgtgccgacggcagcaccagatgaccaagccgaggctccacccagggaagacagaccacccagaccaccgagaccagagaaagtgcggttggcattgacactggagttctggctgcggtccacagtgggaagatcgattcctgagccaacccgtctcatcgagccgaaggggttggaaggatcccgaagtccgctgattccgggatgctgggcgggctggatatccgatccgtcagtgtcgacatcttcgggttccgcacgttcgccatgacggtcaccatgcgggctctggtagggattagtgttggttggactatttggctcgtggccctggaggaggctgggagtggggttccgcgagttctcctggctttgcatcaactctcggaatccaggaatgctcgaggtcatgccgaatgcgccaaatccaagatcagattgagcgggaccttcaacatcctgagaaccgccaagagcggcgctgccactgcgaggctcgtcgaacggattagtttcgcttcggttgacacgagtcttgacggcatctccccagggcgactgcgaacgcccgtcactgtcgttttcagcaagacgttcaaggttacctgtgggcttttccttggcggagctagcaatatcttcagagctatccttggacagcaaacccttgaatctgctctctccgcggagacttccgtatcctggtttcttttcagccgtgggagtgccagatccagagccagaaccaagagagaaagctccaaaggcacccatcggagagaaattggcattatgggaggccgaaccccagggggagtttggtccactaacgcccgtattgataggattggtggagctgcgcttcagagagccaaagggagaggcagggtcctccttgccctccttggccttctcatccaccttcgggttgggttctcggaaatcagttttgcgacgcaacagggcaggtggaggagtagaggtattggcctcatcgcggaaaaatcgggagttgggaccggtaggagacatggggttgccaatcgattctcccgtttcccggcgtcggggacccgggcgaccggcggttggggaggaggtggtatagttattcatatggccctgaggataagagatcgaagatttgcgacctccagctcccgggatgatgttttccttcgcggcgtttgtgggaggtggcttcagaggggagttgacagaagcggagaacatctattaagctttttagtaagagcactcactcagacctgaaagcacagaacacaaacctctttctcatcctccgtcatacccgtgattccgaggggttccacctggccaccgtgatcccagcaaacctcgggccccgcagagttgttcttgtggtcatcccgcttcccccatgctccattcacaggagctgacacagtgtgagggtcccagtcggccacgaagtattcctccacgttcttactcaaggtaccctcctcccgctgtgttttatacagctctagaagttgatccttggagtaccgggcgtccccattccgtgcaatgttagaagtatttgagctcaggtgtggagggatgtacgcgccgccggccgtggatgtcgaggcagatgcaggctggctactatcccggtggtgagatggggtggtagcaacagaaggacggcggaaggtctgcgtagctccgttcatgcggtttcgggacctaatgggcattaaaggttagcatcggatatctcgagctcaaaacattgacggccacaacagcacggaacgatattggaccaggtctgtcaaaacacagctaatggaggggtttggggaaggtgaaacagtgtctgcataccattctccgctagtcgaaccatcccccctccggttggggtcctgggtgttaccagcagcggccgaagcgaaactcgatggaagtggtgtaggcattgtggtaaagaggcttttatggtcggatgttgatcccccacgtaaaaaccgattctgagatagttatcgcgagacctgtggcgggcttgcaagagaatgtgtgatgcgaacggataagttgcaagacacgagattggaaaattggtgtagagttgaaggatgacagctaggagctagtcaatcgaagaagcggggagctgtgagaaaagtaatgcagatatgcgagcgccagactaacaaggtcgagaaaagagagagatcgagtttcgatttcgcttgggaagtttcctggagcaaaaatgattaagcggtgggcgtggcaatacgcgtgccttgttgtaaatacacggtattgtattgccggtggtcgcgtgatttgccgtcaaagagtggggcgttcagtgtattggtggaacaaccaattacataccgccaagagcaagtatccgatacacgcacaacactgtgtcttcatactctgccaggtgtatcttctaccttgctttagacacctttatagcaaagaaaagagacgctgtacgaaaagatgataatggtgactacaaataaccagggtgagatttgaaccagaatactactttcctccaactcaaaaatactatagacaactagcaaggacgtatgcagttaggtggcttgacgcaaacagagagatgtggcaacaacaggctagacgtgtattgcccacaaaagccacgctcctcttttgattggaagttcaactgcttttcagacagtttgacagtgagggattggcttcttttgacttgattttgtctaagcacacaaaggagagtgtctagacgttccacaaatgcaatagagggggttgagatgcatccaataccatccctttctagccaacctcttgcaatactgggcaaacatgccctgtcttaaaaaggttcaacggtcttatatctttacattcaggctggaatccggttgggttaagaatcccattatccagttgtgcctgccaatagggctggatcattgtgtcgccctttgtagacctctactgtccctgtttgtcctttgatgcttcattctataccagacaatgctttctgagatttgctcacttcaagagtcacacagagacaacgcaagacgacacaatgaatgctttagcccaaattgatacgatgggctcattcttagagcttcacagatgttgtcaagaccctataaaatgggcatccccgtctccggcaattcccttttcacagttctttctctccaagacaatccacgtcatcctatgaactataagctttcttgcacaacaaaggtcgtttctctcttgtgtcttccggtccccaagccctcatcgcctttgatcaaagaatatggggcggtccatgttcagcggtcgatccaagcccgtcgatccacaattcggctggtacttcgctggtgagccaatggacaagagacactctcgaagcaggggaatcaggctagttcgctacggacctgagatggaaccttgtgcccacagtcggtgtccatcaccatctcccattacagaaaatacaccttgcacctgcaccaacacatgcgagcttcgctcccacgggacacgctcccaatcccaaagcgactcttactcctctgtttccgagtcagtcatagtatgctgcggaggatgtcacgctatcagacgcgagcccgggccctctcctcaggtggagaaagtgatatgcttgtgtgaatgccactcgcgagagacactcccgatcacaccaagaagcagtggatattccagctcagaatcagccacgaaacgctacggtagccgtcactcaacaagacacgagcgtcgttccaacgacacacgtcccaccacaccgaacagcagtgatttttccgactatgaactgcccaaaagacgccgcggtcaccgcatctcaacacgcgaaccagagcgccatctccagttggagaaattccacggcgaggctcacacaccccctcccagcacaactgcgacgtcaggccagagataccactccccgcgtgcgtcgctcgcgacagcaccacgcgccggcccggtaatccagcgccactgccgcaaggcgtcttactgcgaaaggcacccggagctgtgcagagctacgattcctgtgccttcgccggtgccgagaccaacgccaaccccaacgcgctctccccggtcgattgaaaagccccagcacaagccgcgggccaagccagagccgaaacgcacctacactcaggctgcttcgccttccaagcggacgcctcccgcaaagccagtgccttcccccaagcctatgtgtcccaggcatggtgcccagcattgtggctgtgtctacatggatgggtaccgtgctgatgactccagctattatgctccttatgacgatgacactgtttccgagacctccatccaggccatgcctgaccatgacagggtggacgagacacgttgtacttttcatcaccgctgccgtccaaagttcgagtgtggggttggctgggtctgcgggaggaagtgaacagggctttattcagtgggtggttgtgtttgatttcaatagaaggacgatccatgctgttttctcttactactttctctttttctggtatgtggtctgtttgagtatcaatcccagatatggagagcttcgctggaatgctgtcgtttccgtgtcagaggtccagaaaatctgtctgctcttcttcctctgtccaacttacggtcttgggtgttcggaatgctcgtttattctagcttgacaattctatatcatatggttcaaatttgactttccttttacattattgtagtgttttaggatagccgagatcaaagcacccatagtacctaggtatgtggccaataactctatcaaagcatgacatgaatagactgcttccgcgtgacccatgtttttctgtatcttgagctctatataagcccctatacacaagcacatttataaggtgtcgaaaatatcaaatatacagggtatactcattgtgtccttctagttgtcatcgctaagcaacgtcccgaagacatcgcctctgtcggtatacacccatgcactagaatccctcggctctgcaaaaccctaggaagtactagccactggatatccctacgtgatgatttctttgggccctccattttccattctccttcgataacctcttcatccctttcttggcaggcgagactttacagctggctctggggccatggccgataagagtcgccactactcacatgctaagctcagatacgacgtatagtaaggctatgatatatattcacgtaaaacacgaaactagcaacagatagcaggtttcaaccatcctacacaaggtctccgcttatgcaacacaaggacattatagaactatgaaatgtcactatagaacagcaccagcagctacccgaagacaccatatgcgttctggtgttaggcaaacataatatgtacgaacctggttatttttggttacgacttgtttcaattcgagcttcgcaggctgaaatatatcaggatatatagtcacaggttccaatgtccattaatttgtcagcatgtagtctcggacacctggatcgacattggaaccttgaaacctcggctatcgataagcattttaagcatccccgcacgccccgactttcatcaaaaggcaatttatttttttgatatctgccaatattcatccaacataatgtccaaggcgatttacatatccccaattgacggcaagcctggcaagccaggccaagtctactacccgctctccctgcgcaccgtgcccaagccttccccgcaagggggtgagctactggtgaaactgaccgccgcggcgctcaaccatcgcgatctcttcctccgccaacacctctaccccggcgtgactttcgatgtacctttgctcgcagacggagtcggtactgttgtcggtactggcccgaatgtcccaggcccagaacaatggcaaggcaagcgggtaatcttgaaccccggtgttggttggaaggattcgcctgatggaccggaagaccctgctggataccggattatgggaggcaccaaagtttatgataaggggacattgcaggaatatatcagtattgagtactcggaggtcgaggaggcccctgagcatctctctgacgctgaggctgcggctctacccctgacgggcttgacgggatggagagctttgattagcaaggctggtgagaagaactctggggatggtgctgctgtcttgattactggcatcggtggtggtgtggctctgatggtactgcggtttgctgttgccaggggtgcgcatgtctttgtgacgagctcgagccaggagaaaatacagaaggccgtcgagctaggtgcgaccggtggtatcagttataaagaagagggctgggaaaagaagctgttgggtatgctcccagctggaaagagaagcttcgatgccatcattgatggtgccggtggtgattctgttgagaaatccgtcaagttgctcaaggtgagtgccacaacgggacatatattcaattactggatgaaagtactcacatttccaggctggcggtgtcctctctgtctatggaatgactgtgtctcctaagatgccatttacgatgcctgctgtcctcaagaacatcgacgtccgcggttccacgatgggctcccgaaaggagttcaaggagatgattgagttcgtcaacgctaagaaaatccaccctgtcgtgtcacgagttctgcagaccgagttagatgacttgtccgcaatcgatgggctgttcgaggacatgaaaaagggcacgcagttcggtaaactggtgattgagttcggcaagtctgcgggcagcaagctgtgaacatattcttgctacgattcccatgaagttatatgcctgtatggctgtctataaacatatgatacatatcaattgagatattttgcagcaactacgagtgttcttcgttccttccccctgtgtcgcttcatttgacgcatcaccacatcacgacgtatttgcatatccagcataccatcgctacttttatcactcatactctcttattagaagcgcaatcgagtaacaaaatctcagatccgctcattatacaacgaattattccattcatttccgattccaccatgaactccaagagggaccgtatctcccgacgagtctctcactccgtttctcgaaatggccatgtgcctcttgtgtcggactctcgtcgtatcctagaagattcgtgggatgaaggtagttttcaggtattgtcatatcggggaaacatcgatctgtggaatacccagttggtactaacagtcagtacagtcctttgacgccactcactatgccctgcaaaccctcaacaaacacatcgaacgaagactcgcaaagctgcaagccaatacagtccgcctgaagcgtgagttgtggctgctccagcgacacatcaaagaattccgccatcctcttttcgaaaactgggaagccgacttgctcacccggcttatcgaggttgctcacgcgcatcagcataagaagctaccaggcggcgttgtgatcggagagtcctcgtttgccgaacgagaaaatctcaaccatgcatacagcatcgcggcgaagggaatccgcatgccgactcttcgtaagcttggtctgtcggagaagtatcatcaggctctacagcgatattcagaggtgagtactcgctgtggtcttgatgtaacatagcttggcctagccccggtctaatatgaatcaggtcgctccttatcgaagtccgaatcccttccagaccgagttcgcattcgccaaatggctggtcgaggtgcgggaagacagaccagaactgtatgcattttggtccaagcttttccccgtctgctacgaccgcaccgtccaagaaagcgcctccatcttctagaggattccaaaaatcacttcaccgtcctgtcccgtcacgttttctatctttggctgttctgcggtcaaagcatccatagagaggttgttcagtggatacaatattgcttcgttgtttagagatgttctatttctagaagtttgtgggtcgttgctttggtgtgccgacctcgttctgccccgtgcggttgtgatcatcgtgtctcatctcagctttccacactttccacatagataccaagtctattcttatcgatggcttgtcggaatgcaacgcctgcctttttggtcctatgctcccgatgcatggtatgattttaagaaatagccctaatcgttccacgagctagtagatgatgtcttagcctccttcgacgatcgacggcgtacacacgacctttcagagaacaaactaccaccgttgcatccaatcctagaccacataaccaccacacctgggcagctagtacggtgtacaccggtcactctacaagaaagtccacaaaccaaacaatctaaacgtcaaccgcgctaaccactccggtgcgtctggcacctcctcctcccgtcattctgatcaaacagttggacgatccaaccgtcaaacaatcaatattaaaagcgatatgcaatatgaaacgaactcccacgtgcgcgacctcgaaaaccctattccagcaatcgtgccgcatggagcatgaggcaatccatgccgaattccgtcaccagtagcaataacacgataatgttttccgctcgctaataatagctccttttttttacggagtactatactaagctcgatgctaaaatgctaagtgcgaactaaaaagtgagacagccctaaagcggtatgtatattccgccatgcttccttagcgaggctagcgcaacgctcgcagtaacagattgatcaacctcttggaccgcttttcagggtctatcagctccccccgattcggatatgttccgaagggtcctgttaaagttttgatgggttaggattactagtcttcttttttatgggttgagagcgtttttcgacatgggtatataggctttgacctgtacgttccaaggttattccgacgttcttccggtcgcgttgctactgtgccctttagcttgctatgatctcacacaacatactccgtactttgtacggaggagatatgttcattttgactacgtatggataatttgggacagatcactatgctggtctattttttattttgtgcccttttttatccaatccagtggatacacgtcagtggagcgatgaagtaataagatagagacttgttcacgtctatatccaatataaaaatgtaccaaccttccaaggtcggtggaatgcagtatattacataatgtaccgtgggcacctgggcagccacatggagccccagagaaccttggaatgtggctaccaagataggtagattagccttagcaaaggttaatggctcttaagcgcagacgttatacctacactggcatactatcgtcagataaaattgctgcctagcttggcatttacttgatctgtacgtacagaacgtcaatccacgttttctgatcaagtggagacagcgcaacatggaaagaaaagtggaaagcaatggataaacccatagaccgtgcactttacttccaaggttaagttgtaactgagctatctgagtagcgccggatctgacataaccaaatatgtacctaggtagcgtcttgggactaccaaagggagtgagtgattggctcgagctatcaagatgtgaagcagcaaactcaattcgatattgttttggactgagggtcctgccaaaattaatcccaggtagtactgctaaaattgctaaaaggtcgaaaggtcgaaacctcgggggaaccttggaatggacccgagatcccggccaggttaaaattctatgcatctttacatgctctggttggttgaactaggaaattctccactttcacggagatatttctactatgtatatgatatgccgatactagatacgcagtatagtagtctacatatgaccccgatagcgtctacgttatatacgatttggttccttttcgatccttggcttatatttaggttcagacattaacataagcgcatacgtatatcgaagtataaataaagtgtttctcataggggcatgatcgttcgtcggttccatcaacctgaaactgtacttcgacttcgatggtgacgatccatgaattgacgggggtgttcgcgtcgatcctttttggtgggaattgttacaatagcgtttagcgcggtggattgatccagtggttttttttcccatgtggtgttgtgtacggagtagtgcggtggtgatatatacattgctctacaatacaaccaacatatattttacctctacgccaaccaatttgtgccagcctcttcatttagaaaaacttaaaacaatactaagagaaattgtacgtaccccgtactccgtaagaagtactattattccaattcaaaagagaaatgtagtgtcgcaaatattaaaaagctataacctcgcctcccatatctacccgaccccgcctaagcttctaccaattggatcgccacggggatctttgttgcagcccctgactcgtctatatcacctgaaaagttccacgttagaagatcggccacttccttcagaagctaaatgaatgttaatattacaatctttttacctaacgaagctcgatacggagccaaaatcacgaaaaaaagaagaaaagcaaaactcaaaggacacgggatctcgcatcaaatccacatcagctaagatctacacttaaagcgcccccagataaaggtacctcccatattccctacaatcgatacgcaatgaacacgagcaacgagaataagccaagtgggtacaagatcaacagtgttagcgtggcgcagtctcttccctagtgatgcgactataaatgaaaaacgaggttaacggtttcaggtacggaactaaaagttggttccggcaccgtcagtacggctaatatgccagcgggatttgtccacgctatcctctaatctctaatccgtagcaggcttgatataattatgatgacaatgaaacaccagtggagaaacaatatgagctcgcatggacttgcggtcaagactgacaacagggatcaggctcacctttgagatcgggatttgtcacggtagatttttgcacccaggtagacaaagagacagagagtcggctaacatacctctccatatggatcaccaatgcttcttcccgtagcatctgaatcgagcccactcatcttgagctcgtatgtctcagtgtggagggaagaattggaaggactgccaagcgtgtcttagttatcaacttccgcgggctctttaggatagtcgtgagacgctaagtatattaggggaaagcgcggaaccccattatcgctcagttcgtggaagcgcgggcggtatggatacattgtagactccgtattccatttgtactccgtatggagtgtgtgttcttctcataaccacgtttctcttgagtaagtgccaagaacagttaaagctagcaatgacggttcccaccgtgatataattctctgcctgtgagtggccatcgaggatggcgctaatggcgaggattcatgcctccctctggatgcctccctctgggattaaaggatcgtcgacgaatggggctaccctgtgggagaagatcttcgttgcagggggcgaaaaagaaaagaaagggtccttgaagacatgcagctgattctgagtcgtgattcgcgatctttggtcaaccattcgtcatggcgagatagacacccgattgcactctgtcgtccagctgcacctgggtacgatagacgatcccaacactgcaagacgggtccttcaaatctcttcacttagattaaagatacccaactccgatagtatttttcttttcaaaggagatgtagatgtactccttaggtgagcaagtcgaaccacccaagacccaaagcgggtccacgtcacattcctccgagctgtcgtgcagactaaaccttgatgtgaacaagggtaagccagtgaccttccacccaacaacgacatcggttaaaaaaaaattcgaggatcgttgccgtttgtctcccccttcgtgaacaggaccaggaggagctgaaataaaatgtaagggtggtgaacccaggcaaaaagagagagccatcaatgtctctgacgatgtttcactccgagggtttgtttccttccctaaggtccgcgcaccaatccccatcccactatgcagcaaggttgacatcttcttgttctcccttggacttcgccctcgaaaggattgacgataaagacgaagatccttacccaataatccaataatcctccttaacccgtgctcgggatgcactgttgcccccccacacacgcaagacagaacagacacatacaggcacgagtggcgccatcacgtacataatattgacggatagggagtagacacacaggcaatagtgcaattgtacctgcatattgcaaatgttagatccctagaaagggtaagatcgtagagctaacctgcaaccctttactccgtaactggtacggagtaggtagacaagggactagggttgaacgtcgatccaaagcatgggtaacatgtcgttcgcacgaaataatctaaaaaaacatttaattaacgtttagtaggcgcgggggttttgccaataggcagaaggataaacggtaaaagatactccgtactccgtacataaaaccaggaaccggagagcccgaagcccttggtggggtactgaccccgttcaatagtgtaccatgatgggagttggattggaccccctgccaatagtattgtcgagtacagtattgacggcttcaaacaaggttgcaagtccgaagtcctggggaatatgatgatccacctttttctttggaagcttcgaaggatgtggaaggtcccttgacaaaattgaaaattattcgcagcttgaaacactagttaggagatggagttgatcaatgggggttaacagctgcgtttttttgggaatattatttaatttttgtagctttttcatcggggtttttcctttttgggagttcggggggttgggtttttgatgtggggacgggcattactcccgaagattggccgattatatgcaaacgccaattgggatttccttggggaaatgtttcccgttacaaactaataagattatctggttttccaaatattctaaagggataaatgggatttcatatagattggacccttggattagatgctccttactccgtactctgttagatagtatagtttaattttcagggtggttgggtgggtggttgggagttaaggaacatgaacattgacattgacacatttagattgacctgcatgtagggaaaattattaactatctcctaacgaatggcaaggaagaaggaaggcatcaaacaataatctatcaaaccaaaattgtctgaagaagccgttttggaccgttttggactcgatcgcggatccgattgaagcttcttggggagattgctgatcattgcgctccactgtgcattgtacggttccgacgccctattactcaatttcgagagctgacttgactattttggttcggttcacaaatagtataccctaaaaactgctcatagtgtccacacctgtacgaagtacatatatcgtacaccgtactccgtacctcggaacgtcttcaacgtggcaaaatcgcggagtcaaagtcccttatcgatagcagagcgctttgataaatactttttaatcccccccttttatccctttgctacatcgtgggtggctggagctgcacgaaataatactcgggaattgtgcatccgaaccgttaatgtttcctgtttggtttagcgtgttttttgtttttctcttatttttattttcataattctttttttatgaaggagtcaaggatatctacatcaagaaataaacttctttccaataatgcttcccgaatatcttgaacccttgtactccgtacggagtagctatgatctcatagcggacctttgaaaaaaacgtatacaagaattgctgaaagaaacccttacggacattttggattctattttcgacatgtgcgtctgcgtctgcgcctgcatctgcatctgcgtctgtaacaataacatggttgacgttcttacggaactgcagaccttgacgcgctgcgtcgggtaattttcttgtagaacaataatgatctcctgcgcattggggatttgcacgatcaacagggcctggggagcccatggcccgggagccgttggaatatgaattgcgtccatgtagtacatgaccaggcgtagtgcatgtccgcctaatggattataatcaccaacctgcatctacatagatatgtagtcatatttcgtatgctgatagcgaatatggatatgatctaaatatatacggaagttaagatggataaggtgacagtgcagagtgccccagctgatggaacggtcctgttacctcgagggagcacggatgctcgggctcaaagtgatacccgatcgggtctagaggggtggacaggagggccagaagagccaatcacaggacaggacccttgcatagtcaggccaccgagtcacctgaaaatgcaaggtgtgctaaacttagacccttcgtgtttggtttttctttttctttttttttttttctggaaatctgagcttcggtttccaaggttggcccttcgtactcgtttatttactttcgattcgattctgttcgggtccgatgacggcaagcttaagagagtttccaagattggccaatacattcggaaatagttttggctttgccgatcaggaaatatctggggatttactttcaatcagctgtggtacggggagtcttatggagtacacatcatgctccgtatatgtacatcagcctcgtgtcgggtcggggaaaggaaaatgtgaattatcaaattgaccggcatgacgacacgatgtgtatgtactccgtacgatcatgaccctatgtacggagtacggagtagggaagatcgtaagtggagcgagcatctggagaaaaagagcgaagggtcttgttttgccagtttggttcggcacggatgacccaagggtcggcgtaaggagccgctgacaaagggatcaacttcagatcgtatcactgtatgttgtacaatataaggaaaaagtgtcattgggttaaaaaaaggatcagaaagggttccgaacttgaatggaaaagtacccgaagctgatgtaggggagctaaatataccaaagaaaaagaaaaaggaaaaaaaaaaaaaagaaaaacataacagggttgccggtgaagctttctgattggcagggataatagtaggagaggagcccttcggagagagtcctcgttatagacacaatccctgattggatggaccttgaccttgtcaacatggatctcgttcagggttacagtactctacgccccttttgggggggaaaaaaaggaaaaagaaaacaatgaaagaggctatgcttgtcaagtcacctggggaagaaccagcacatacacaaacagcgcacaaaggtaaccatcgggctgaattctatatggaaataaggcgattcttgttctgcagacataaaatatctttttcttttttttttctgccttccacatgctggatgattccccacttttctttcttttgctagcggcgcaggtcgccagattggtgtttatcccgagaaccgcaccacgttcctttttctgtccccgatgttatgcgcagatattctcatttttggttacctgttccaaggttcttgaaatagaaggttagaaatgtagtcaagaagatatttttgttaacatcttattaacatcatactatctaaggaaaaaaaggatataggataggtggatctgactggtcggacacctcgaaaagcataacaagtcggcttctagtggcttccgacacactggttaactcgtttgtaaatgtctccctttatgatatcgagactcgagactcgaagataattatatagattgtgtgaccatggtaaagaatcaaggagtacctacataagtacttgatacaatataaccttggttatcttattgtatctatgtcataggtaataatacccaaaatacccaattgatgccaagttgaccccctctgtgcatcccccgccaggatttcccactagtcttttagtccgactactttgagagatcaatttaattgaatttattattattattcataattaaaaaatatcataaaaaatatgataaaatatgataaaaaaaaataatatactataatataatatacaaacccaaaaaaagttctccccccacagggccttatacagtttaggtcgtaaattgtactcttgacctgctctcttctgactgctaataataatactccatagaatcctcaatgcttttaaccctgctggtcccatcttccttgcatcccactttccatcccccttggaaatttattatgactttctaagtcacacattcgctcaccacgttcgctcttacgctcgcttacctgctgctacgagaaccacgttcgctacgtttattggaattataactcgccctttaatctttaattctttttttcttttccttgctgaaaccctggaatattcgccaattctattttatattcgaaacgatttggtggaagggtcgataaagtgtcatttgccccgacactgcgtttgcgcgatatctctgtagatcccgtttgctccgcggtctcagttgaacctccaaccttttgcgcaaaagggaaaaaagggaaaggaaaaaaaaggattctcttcgggcttttgtacttgcgacaggctatactacccgggtactggatactggatattggacacaactggattacagaaattcaaccattcgctttcttgtctcggaagacactccggaattctagtggaatcgcctccgtttggaaaggtctcagagtcattagggaatattggatacaggaaaggaaccattcaggcagatcggttcatcagcttaaggttagtatcaatgtgcacccctccctttgcccacggtctcacttgttcccctcgtgccttgcatacttcctctttcggttcttgatctttcgtgttatgctccttgcaggaatttgtattctctggagtataccaacgactggaaatgacgatagttgtcaaagccgtcggatagcttccccgtcccgctattgtccagtgtttgttgacattagtctcttcttcaggtttaacgagactcggatcttgcatattatcttggaaggtcaacagccagaacttggtctcagaccagaaccttttccattttcactttccatctcggtgagttcattcccccctatgcaccgatccggttcccatagtctgaaaacgttctcgtatactcattatttgagtagcctatcatctggaatcttgttcattgtggcccaatctgcttgacgctttcccgaaacacctcgcggatcaaggaaataaagaaaagcgaaacctctccagtccacgctcgttgctcgccatctcaaccaatctcggcccttcccgtcacaattggcggtggacattgaacatctactaagcgactagttcttctgcttctctttatgaacctttgggcactacggtcgagatttgagtctattcctgcagccaaccgttcctagtttcagccttagtggtttattcctggatggtgattcgaggccttttgttgccgccatttttgtgagaccaacagcaggttcgtcttgtcgctcgttctgtctcggagagcactccattcttgctcgtgcttttcgaccctacaatcgtttggaataaattcccagtcattcgcttcagaaggttctgtcttgttgcacttgttgcaacatcttcaagctggcttactcgaagacacacggtgttttggtaagattcccaccccagatttggatttgtctctctcttcccttgtggatgcccgcatgttttgcataggtgttccaatcccagcccagcatcttgtttgaatcttctcaacccttgctctattgcctttttttttttctgtgtgcacaagaaaccttcccgctgacctgtctctccttgttccgtcacagttcgacccagattttcaaacgcctctaatactcggcgagtcgttggatctgtcggactcagaagaatcacagtttgtcggtgcattttcagacggcctgtgggccaagtctgagcccatcctgtccatgtctgctttccagaagcccgttgccggcgccatactaggtacgttgcatttgaagaactttggtttgctatgatttgggaacgtcccgtgtgctgagaccaaacgcagattacggttccactcggtctttgcatgatgctgcttcttactcgaactacggtcaatcaccttatgtgacgaccccgatggttccctcgcccatggccgccgatcaggcgagtcagatctcggattgtgttccgtatctgcccaacgagtatgctagctcgtacgaggagtctcagtcgcccatgttgggcgcacgccaccgtcagctacccgaaattgtgacatacagccctcagcgcggaagtgaaggaactagggtgatggtccagatccagtgcccctatgacctccacgcttcttcatacgcagctttgtatgttgttttcggctcaaagaagtgtgaatcgctcccgcatttccttggattccagggctccgcgttccagtacggtctttcggctgatgtacctccattcttgtctactggatccccatcttttgctgttcctctgtccgtcttaatggagacccaggatgactctcccgccacctcgcttcaggttggtgtgtacacttatgagcaagctgcccacccttcgccatcagcggattcccgcaagagaaagttctcctcatattccgatgttcctgcggcacctgctaagcgacacaacggatccgtgatccccaaggttgagcaccacgacggctaccacagtcgctctgtgtctgcgtcttactcgccttacttgcagccacttcccgccatggctgggttcgtcgcaccataccacgctgcatcctctccccagacaggctctggccaatactcctcttctgccacccctcagcccgccctccgtgttccttcccctatcaccccagcttggagcccctctttcgtctctgtgagcaatgatggtcgcaactctggtctcgccttaacgcatggtgtcgctcagcacaaaggtcccacccagcgtggttcttcaaatcccactttgatccgcacctccaccatacaaacgcacagcatgccccacaacccagccttcaacccttatgccatgtatcccaccaaggctgtcctcaagctcaacggtgatctcgacagcatgacacaaggctggtcgaaggaagaacgcacgtcccaacgccgcctggtgcaattcacccgttctcaaactggtagcaccatcctgggcgagttcaaggctgttacccccgaggatcgcgctccaagcagtatttgcatcagctgcattttgtgggaggagaagaatgagtgctacgtgaccagcgtggacaccatttatttgcttgagtccctcgtggccgtgcgcttcactgtcgaagagaagaatcgtattcgtcgcaacttggagggcttccgccccctgaccgtctccaaggccaaggtcgacagcgaagagttcttcaaggtgatcatgggcttccctgcccctaagccacgcaacatcgagaaggatgtcaaggtcttcccctggaaggtcctgagccacgcactcaagaagatcattgggaaatacgtatgttcttgaattccacagctcatcgtgacgagttactaatatttgtcttttctctagtctgccagctattcctcaaccgccggtgctctccccacaccaatgaccaccacctacaccagccatgccagccatcccagccttggcactggttctgattccggtaccgagcctcacactgccaactccccccagtccatctccgacgctggtgctagcaacacctacactggtatgcccgtccagacctactcgcaggcagatcactccgcctcccacatgtcttcggctcctgagctccggtccatgaccgcagcctcccagccctatacatctgttggagcatactcgtacccggccatgtgccacccccagagtgccaacggtctgccagctacagccccgcgagcttcttgggacatgcagcctctcggccccaacgctcctcacactggcgcacccggaaatggcacatgctacacatacctggatcccgtgtactcgatgcacgattcggcccacggcggccactgatccccttacctggctggtccttctatctgatctcttgctgcgttttctttccattctatttttcatactttcccctccgccttttttgaagatacgattttccttttctcgtcactccttaccaagcccagacagcgggttgccagcccatcggacacaaggtctcttctcacctggaaaggtagcgagagcccttgtatccgctggaacctcgcatcccacacattgatcatgatttatgtccctccttacactacaacatcataatgcctgatgccctcaccatacacccaaacttgcgaccatttgcatatctgctttttgacttttttttgacttttggaactttgtttcactttgagacctgttcctcgcatttagacggtgtcttgttcattccttccttgggtgcatatcttacatgccgggcattgcggcttccactccttttttgagcacaaaacatacattctgggcttttgtactactattcagcatagcgggcgcttgcttgtcattccttttgcatttgcgggttattttcggattggaaatgggatagacttggggtttgttttattggaatcttggcggtcttgtccattttatccaattccttggtgcattttggacggggttcttgggcaaggatttctggcacaatggacttgtcttcatgttccgggtcttcctgctctggtccctgtctacttttcacttctctgtttgaaagtttggctcggagttcattcggtacttactacttcttgttatttcagctgagggttgttgtcacttactacctactgcattgttccggcgtttgggacttgaacggttggaccgtttattaccctacttttctgccataatattacttattctgggtcacagttgttgtactgcaaatcgacagattacttcctcttgaatcattcttaatcacccttgtcttgtgtattatgtagcgatgaaatgactcgatgagtgatgtaaataatatcacgtgagaacaccaaccctacacccatgtctcgtagatacgataaggtcaagtgacttactatcttatcaacacgtgacctgcggggcccagcgaagccggcctcgaaaaagccctggagagcaattgcatttgagtcatacagatcgtttgctcttttataacatcatcttgccccagtcctgacataacaattcacgtttgattcatcccaactttgcacatatatatagggactgtttgccttccattgacctcttctctttcttcttatcaccaccctctcttgccccgccactgtcacatcgcctttcattcataatggaagctatcaagcagactttcgccaagtgcaaggagcagaagcgcgcggcccttgtggcatacattactgcaggataccccactgttgaggaggcagttgatatcctccttggtctcgagaacggcggagccggtaattcaaccccaagtgaaagttgctcacagagatgatctttactgacattcgatctcacttcacagatatcatcgagcttggaatcccctttacagaccccatcgctgatggtcccactattcagaccgctaacacaaaggcgcttcagaatggtgtcaccctcactactgtgcttgagcttgtccgcactgcccgcagccgcggtctgcagactcctttgatgctcatgggttacttcaaccccgtccttaagtatggtgaggagcgtatgctccgtgactgcaaggaggctggtgtcaatggcttcatcatggttgacttgcccccggaggaggctgtccgtttccgcgacctctgctcgagcgctgggtgagtttgtctatttttacttattttcacatctttatcgcttgtctatggttatccagcatgcttattcccatttcagtctctcatacatcccgcttatcgcccctgctacctccgatgcccgcatgcgtctcctctgcaagatcgcagacagctttatctacgttgtttcccgcatgggcgtgaccggtgccaccggctcattgagcgcaaacattcccgagcttttgaaccgcgtccacgaatattcaggcaatgtccctgctgcattgggattcggtgtcagcacccgtgagcacttcctgtccgtccaggagcaggccgagggtgtggtcattggcagccagattatcacttgcgttggcaaggcccctgctggccaggctgccaaggctgccgaagagtacctctccagcattaccggacgtaaacgtgagcgtgatgccaccggtgcctttacccgcgagatcaacgtccttgaggccgttgagaaggccctgccttctagtcaggtccagccgactaaggtcatcaccgatgccgatacccccgccggacctggtcttgctgaccagattgaggccctcaacgtcacaaaggatgcatcttcccagccctcgcgcttcggtgagttcggtggacagtatgtccccgagtcccttatggattgcttgagtgagctcgagcgcggctttgatgtcgccaacaacgaccccaagttctgggaagaattccgctcatactacccctacatgggccgccctagcagccttcacttggcccagcgtttgacagagcacgttggcggcgccaacatctggttgaagcgtgaggacctgaaccatactggtagccacaaaatcaacaatgctcttggacagattttgattgcccgtcgcctgggcaagacccgcatcattgccgagaccggtgctggccagcacggtgttgctactgccacagtttgcgccaagtttggcatgaagtgtaccgtcttcatgggtgccgaggatgtgcgtcgccagggtctcaatgtcttccgcatgaagctccttggtgcttccgttgttgctgtcgaggctggaagccgcaccctccgtgatgcagtcaacgaggctctccgcgcctgggtcgtcgaacttgataccacccactacatcattggctctgctattggcccccacccgttcccgaccatcgtccgtactttccagtctgtcattggaaacgagaccaaggagcaaatgcaggcacagattggcaagctccccgatgctgtcatcgcctgtgttggcggcggtagcaacgcagtcggaatgttccaccccttctccaacgatcccagtgtgaagctcatcggtgttgaggctgcgggagacggcgttgataccaaccgccactctgccaccctctctggtggttcccacggcgtcctccacggtgtccggacatacgtcctgcagaacgagcacggtcagatctccgacacccactcgatctctgctggtctggattaccccggtgtcggccccgagctgagcaactggaaggattccaaccgcgccactttcattgcggccgacgatagccaggcccttgctggattccgtgccctcgcccaacacgagggtatcatccccgctctggagtcctcgcacgccgtctggggcgttatgcaaattgctaagaccatggagaagggccagaatattgtcctcaacttgagtggtcgcggcgacaaggatgtccagcaggttgccgacgagctgccccgtctggggcccaagatcgactgggatctgcgcttctaagcgcttcaagcatcatttctatgctctttcatccggatgagatttcccgcgtccatttctttctggggtttttttttttccttctttttttcttttcggtcctctggcgagacggaggtttcatgatcccttgatgcattgcgggatggtcatgaaaaagcgttactattgcagtcttttctttcccttgatttgggagttatttttttttttttggataaaactagaaaacggaaaaaaagagatattgatatcccctttacagtctttttgtttttcatctttttggactgtcttcataaacatagatagctttaggctaggagaacaatgacagcctatcatctaccatctacaagaccactcactatccgcacaagatcgacgtacaaaccggccatcccataattttatagagagcacaaatagcccgtgaaatagattcgataatgtatcatgcttgagcaagaagaaaccaaaagaaaaacaaccaagaaacatacgaacggccgcacaacaagaacaaaagataggagtatatgcaattgacatagaacaaaacgggacctactaatccctcgccaggacgctggcgttccacttctacctcgcaccaaaagatagaatccccggcgatagtttacttgaacatagcacaagactcgggattcacctcatacagcaccacatcacgcgtcgatcaggttctcacccgagttatcgcgggtatccttgttagggatcttgcgggcatggcgggcgtagaactcgtcgagagtgcgcttggggacacggttgaggagttccttggggtagatgcggagaaggttccaggcgatgtcgagggattcttggatggtgcgcgactcgtagggagactggctgatgaaggtgcgctcgaacttctcgaggaattcgagggagagcttgtcttccgaggagagggcttcctctccgacgacggctttcatggcggctgtttggggtggttagaggtgttcatgtgatttgggaggatggaacaatgtaacgcggtgttctttggggtgggttgcttaccggcatcacgaccaatggcgtacttggcgtacagctggttggacacatctccgtggtccttgcgggtgcggccctcgccgatggcggacttcatcagacgtgatagagagggcaggacgttgattggtgggtagataccgcggttgtcgagctgacggtcaatgaagatctgaccctcggtaatgtaaccagtcaagtcgggaatggggtgggtgatatctgcgtgggtatggtttagtggggttcagcctgaggggtggactgggcaacgcaccgtcgttaggcatggtcagaatgggaatctgtgtaatagaaccattacggccctcgactcgtccagcacgctcgtaaagggtggacaaatctgtgtacatgtaaccgggataaccacgacgaccggggacttcttctctggcagcggaaacttcgcgcagagcatcacagtaggccgacaagtcagtcatgatggtcaggacgtgcttctcgagctggtaggcgtagtattcggcggtggtcagggcaagacgaggagtaatgatacgctcaatagtagggtcgttggccaagttcaggaacagagtgacacgctccatactaccgttctcctcgaagtcgcgcttgaagaaacgggcagtctccatgttgacacccatggcggcgaagacgatagagaagttctcctcgtggccgtcgtgaacatccttggtgggcttagccaaacttgcttggcgacagatctgcgcggcgatctcgttatgtggcagaccggcagcggagaagatggggatcttctgtccacgggcaatggagttcatcgtatcgatagcggagataccggtggaaatcatttcctcggggtacaccttgtccattcgttagcttcccgtagtcccatctcatatcggtggcagtgcgcatactcgggagtaggggttgatgggctggccgttgatatccaagtaatcctccgccaacaccttgggacccttatcgatagctcgtcctgaaccgtcgaatgttcgacccaacatgtcctcggagacgccaagcttcaagctgtggccgctgaactcgactttggtctgagcgatctgtcagcacatccgatattcaaatcattaccgcgagtaattgtaccttcttcacatcgatgccggaagtgccttcgaacacctaacgagctacattaatgtcttgcatattaggggcgaggttatattccgcacctgcacaacagcgcggtttcctatttgtatacatagcaagtcagctttcatactcctaaataaacggcagaatgtggggaacggacctctggcttccagtacttgaccactgcgctctgagccatcggggagcgtcaaggaaacgatctcgttataacgggggaacttgatctgtttgagaatgttatcattagcatataattcccactatattgtcagagcatcatatgccaactcacattatcgaggataaccagcggtccgttgatgcctccgatggtattgtagcggaatcggggcttgatggaggacatccgggggtcaataaagtcggccatggcgaatctgatcctccacgggcgaaattcagagtagaaaaaggcaaggatgggggaagagagcaaaggtgggactgggggggttggtccagctgtctcgatggggagcttgggcggtgacgttgcacgtgatgaggtccaagattgcgtagacctggtcttcatttcttggcgtttgctcctccgggctttttatattgcacgttatactacagttcttggtgtatttggattattttcgatgattcacattattcctactaggaacacaaataatggaatggcggcagccagacaaaatctgacagggatatcagcagatcgaacgctagcagaagcgctgctctttcgtccgcggcgtggtcgcagtgaagaccccaacagcaggcagttcactagatctgctactgggagtcatatccacagattctgtacccggaacacccacatcgccaagcagcgcagcatcaggagcagcccgggtactaccgaagcgcagaccactgcccttcactttcataatggacaccattaatgataacccctctcgggttgaagcatataagcccgaggcatatttttgattaccataaaatattcggagtagttacattagaaatgaaacaatgatctatgaatttatccattttctatgcacatatgtattgtatgaagcccagcggagggcggacatgttttgttcaaggtgtcatgcatattagaggccaatactaagcaattaaggtaggtaagtaagattgctgacgacgagcaataataacacggaagacccgatcaaaaaagacagttgaaccaggagagaagaaactcatagtaataatgtgagatgctaagcccatcaaaagcagggtatccatacgcgtgaaatagagacagcgataatccttctaacgaaccattcaaacgcagtgcaagataggcgcctcaccatgatccgatccatgaaaatgcaaaacagaaataaacacaaagaaagagagtggatcagtccactttagcttgagcaaggctctttggggtaactagattattggataggcggacatttgcagtgcccttgagcttgtctttccacgtatgcctcttcaactttcggcgtgcaaccattaccggcacagaggaactagaaagaagatagttggagaacgatccgagaaggacactgaaggtaaggtcagtattgtctcctgcagcacgataaataaattcaagtgttactcaccccttcagtgcactctgaccccgggcgcccacaataacgagtgtgggctcaagttcatcaatctaaaagtcattataagtatggatcagagattataaggaggtcgagagcagacgaaacacttacagcttcagtgatcatagacttcgggttcttgcagtgtatcacctccacggcaatacggacctgcaagaccgttttccgcagcagcttcacacaggtctgagacacagtctcaactgccctcactcgttccgcctcagctatcgacgatgcccgggaatcagcagaatgcgtcttgctggcagtaccagggccaagtcgaccgagtattgtacgggacccataattctggttagcttctttcgtctgggtgccaacgacagccgttgcatctttcatcaccttggctccctcgccgacctgcacccctgacgcagtagtggagtcctcgtgcatggcgtagatggcgaaaatcgtgtctccatctctcagaaccgtcccgatggtccattcaagggcatagacggactcttcactcaagtcagttgcgatcaaatatttccgacggcgacggcggatcccatcgccttgatcctgcgggcttgaaaagttcccgcggacaattgttcggatggaacggttgtgaacaccattatcaatagctgacatggaaatgctaagcttctgggcacgatgaatgtcaccgatctcggcttcatcctctgagccgtaaggtgtgccagccactgactgaacacgcggggtggggatgtcgaaactggtctgtggatgaaccacagctttcaaagcagatttccgcggtttcttctcctgtcgtccacttggaacattgggggctttttctatataatgtggtattagtatgctggattccccatttaacagaagtcccgagaaggaaggcaacgtacgttcttcggcctgcttgaaattgtcatccttggatttctcaaagtcgcttggcgttatagatgtgatatccgagtccttctttttcttgcggcctcgtacaccctccagggtgctgtcttcgtcgctcgaagtatcgttggcttcatcttcactgctttcaatcatgttcttgtcgcgatcgaacacgtccttggctagtcgctcccctccctcttccacagctgtcggtttgatataatcaggcaggcttccatggggtttagccaatgcctcatctgacttgttgaatgcatcgtgcatgttgagcgacttccccttccctgaagtaataggggcaggcgtcaaggtttcaacgtgaacggaatgactgtcggaggaactggggcgaccacgctccggtgaagacgcagaacgggagtcgagagacgatccacgctgggaagatccccgtgatgagtctctgtctctgccacgggaaaagcttctcgggaagaggcggccagacattatggcagccacacccttgcggctctgggaccggtctcgagcctgcaaaaatcgctttttggcgtgcggctgctctagagaagtagaagcgactgcatcattgtcaacggtaaggcgacctgcggctgagctgacagtgtcaacgacctggtcggatgatctacgagggaaagcctcgcggtcggcggtgtgtctctctggcgaacttggggcagatgccatatctgacgaactaatgcgcaaaggcgatgatacgagtggctctggactgcggattccgcctgctctgggcgaataggttgtcccgctcgcactcttagattgctgaccaatctgcaggttctgcagtgcacggcttagactcggtttgtcagttattgatattgtagaccgaccatccaagcttttcagttcagtgggagaagttcgaccagtgtggtacgacatgacgacaccgcctccgggttgtggggaacttgagagtcgccgtgagcggagtggtggggccaacacgtgaacgagtctgccaaggtcgtcccgaagtcgttgtcggacgcgtgagaacgcagtcttacctctattggggccctccactgtttcggattcagcgctttcctcagagtaatctttcagttgctgcggaattgatacagcgctttgatgtggttgtgcgtagtagcgtagccttcaacgagttgacgtgtagcttgcgtgcgagctaaatgaccaatgggctccggtaagtaatacgcaaagcagcaatctgagatgactctctgaaagagctcaacgtttgaatacacgaccggctagccaagcagcgagggcagctactgtaacgactgaaaaggcttcagaccaagtgttgcccatttgttttgcgcagcgtaagttgttcttggtatgattaagggaaaaagaacacaaaggaaaaaccaaagacctatgtagatttggggaaggagcctaagttgaggcttcttactccagccacagtggctacatgtactataaattttacgctcggggcaatctacttcctacaacaatatcatacacgacgcttacgatagaaacaataccactaaaaaattacacgagaacactcgtcattgtatttcttgtcatatacatcaccccagtctcagtcacgatccggtctcggcattcaaagtgagtaaagacggttttacccggtcttagcccagacataatacacggtgtcagtcagttcggtaccggggccagcggaggatgccatagtccggataaatgcaagtgagagctgatggctatgggttgggttctcgacagtgagataccagagacctattgaaggaactagccgaagagccatcttaaaattggcccgtccacgcccgacgacggcattgggcaagaaaagaatggctgtagctaatttcttcaatccctgctcggctcgggggcatgaaaggatcgatatattggtaccaattcggacgtcgacagcattgtaggcgctccttgtggagttggttaagtgtagacacagacgctgacatcgtccaacccctgctgccgcatcacagcgtccatcttgattgtaggatgaaaatccgtatggatgcaggcgtgtcgcgggctgcggagtcctccttctttttcttctggatggggttgtggttagctacggcggcagcgggacctaatacttgcctttgtcgcggttcaggtaaatggttcccggtggaggatatctgatacgaccataacacatacccgtatatgaagattctgcggaatactcaccatttcaaatctgtcactagccctagaacgccttttggcaaagtccctgcgtcattgcagcatatcccgggtcgggtgcagttcacctagaactgctattttccttcgacctcattccaatcgccgaactgcaaccctggaacaaggaatacgctagaaaggcccgctcgggcgtaagtagggaggctagcggcagtattggtttcgaaacggccctctcgataaagtcggcgagtgattcgcgcgcggaggatggacctaataaggctgattgcggagcgaagcgaagcaatattagaccataaccccccaaaatcgtattccccgatatatatatatatatatatagagtaggatagtaatatcgctactaaaaccttcatctagatcttctagcgtctttttagaggcgactagtattctccggcggctagagtgacattcttagcggcggtaaatagcgtaaccgtgtcctcggaggaagtagacgtgaacttcgcggcgaaaagagggaggagaagcaggagggcgactctagcgaggtagagaacgacgtgtaggacaccacatagtgcggaaatttcgtaggtatctaggtatagttagtatcggaggatgtagcatatatatcggaggcttacttgctatcgcgggcgtaaacgcggccaccggacgtaaggggtagggcaagtgggccttagtaataactaggacgctgtgttagtacgtcttaaggcgtggggattacctcgaggcgagcagacaagtaggcgtagtagtagagataggcagtgggcgtataaagaagagaagaagaagaagaagaagaagaagggaagaaaaattgaatgtatagcgggtgggagagggcttgcacctacttcgctccgtatgactatctagaggcataaggcccccaaggtcactagtagaagttagtgtggcaagaacccttcccacctgccatataagggggatgtatgaagagaagtatcaggttaagtagccagatggagaagaggtgtagtgaaggagacaatgggggtttatgtagtcaggcaaacatggaaatgagaagtaaaggagagagagcaaacatagacctgaaaagcagattattagatgtccctctcttttcttctctctttctttctaatgtatcctgctttaccatttcacattgaaatcacttcttacatctccatatagcccattgataagattcatattctagaccccttcaatgttttcaattgattgaaaagaacttgatacctagtgtgtgcttgcaataccaattgatgccttgcactgcctgccctgtctgtcaccattattcaacgagacttatcgacgtttgtaggtaattcgaaacaagactcacgccttaaataaagacatctggagaagtcacccattggagaaattttgatatttcgacggataatggtttcttgggttggtcataatatcatatagtattctcaggttctagcagactacataggttgacactgagataaaagcctcagcgttacaaactaaaatcatggctggtatcccatggaattggcttgtagtactcacagtagtattggctgttataatctgtccaacctcttctatcaccttgccagttaacaacttaaaagccctaactggcctagtagaattgcagaagaattgccttcaactataagatgtgaaggtgcgcattgacatgtggagtgttgattctgttctaggaaaggatctaccatgaatgatagtgctataagatccccgaatgtaacctgctgtggcaagattcctttttcgttcattggaaatagtaatggtccatagcacgtctggatgatctgttggaacaaccaaaaatggattggctgacatgtaacaagagtaacatccaggtgtgctcgaatggtcccagaatatgcactgcagggtatactcatctcatgtatttataccttgtttatgcctggcaatgaagttcaatatttcaatatttcagctgccgaggtatgagattaatatacaatatacgcgaaagtgaagtggcaaagagccctcggtagtgagacacctcggaaaggaacatccgtttgaacgttgggaccaatcagagccttccatatgtaagccgttccagatcccgccagatcagtcagcccccaattttcccttcgggtccggcttttggtattgtgaactacatatctcctcgaattcacggggatttcttctattttgtttctcgttttctcaatttggctcaatttggctcaatataaccatggaggctctcttgcaacagtctcgcacgatgtgccctttcctcaagcgcacatcccccactaccctccgcactctgtcgaccgctactcgtcctagcccgggaggtggaaccatgtccaacctgcaagtcctgggtcgccgatgcccagtcatgagcaaggctctggctgtgcagagtgcccgtcttagtggcaccaagcgcttcacctcgcgcgccgccggagtcgctggatgccagtctctgcgtgttcccactggcaagcgggcgcttcacaccaccggtggtcaccccgctagtcttgcctctggagggtacgagaagaatgagcgaggtaaattgagtttgtgaagcttgggctttgagctgtttctaatctgactacaggaaaccctaacttggccaatccgctccgctcgtcccctaccgccgccggcgtcggcactgcagtccgcggtccccgcccggaagccccagccaacgaaaagttcaactatggtaacttctataacgcggaattggagaagaagcacaaggacaagtcctaccgctacttcaacaacatcaaccgtctcgccaacgagttccctcgggctcacactgcctcggccgaggagcgcgtgaccgtctggtgctcaaatgactacctgggcatgggtcgtaacccgcaggtcttggactccatgcacaagactttggacacctacggagccggtgcaggtggtactcgcaacatctcgggtcataaccagcatgctgtcgccctcgaggatacacttgccaagttgcatggtaaagaggccgcattggtattcagctcctgcttcgtggctaacgatgcgaccctgtcaacactgggcagcaaaatgcccgattgtgtcatcctctcggacagtctcaaccatgcctcgatgatccagggtatccgacactccggcgcaaagaaaatggtcttcaagcacaacgatttggaagaccttgaagccaaattggcctcattgccacttagtacccccaagattattgcctttgaatccgtatacagtatgtgcggatcaattgcgcccattgaaaagatttgtgatctctccgacaagtacggtgccatcaccttcttggatgaggtccatgccgtaggaatgtacggcccgcacggagctggcgttgctgagcacctcgattacgacgtctacgcatcgcaggatacagcttcccctcaaagcaccaagggcacagtccaggaccgaattgacatcatcaccggtaccttgggcaaagcctacggctgtgtcggtggatatatcgcaggctcggcagccatggtggataccatccgctcccttgctcctggtttcatcttcaccacttcgctcccaccagccaccatggctggtgcggataccgccatccagtaccagtcccagcaaccccgggaccgcatcctccaacaactccacacccgggcagtcaagaccgccctcagtgatttggacatccccgtcatccccaacccctcacacatcgtccccctcctggtcggtgatgccgagctggccaagcaggcctctgacaaacttctcgaggaacacggcatctacgtgcaggccatcaactaccccaccgttccccgcggcgaggagcgtctgcgcatcacccccaccccaggccacgtgaagccgctgcgcgagcacctcgtgcaagccgtgcaagccgtttggaacgacctaggcctcaagcgcaccagcgattggaagagccagggtggtttcgttggcgttggtgtcgaaggcgccgaggccgccaaccggcccatctgggaggacgcccagctgggtctgcaggctggcgagaccctcgagggcgctgttgctcgtgaatttaacgacgcagctgcccaggccgccgtgccgctcctgaaggctgctacccctttgaccgagaaggcttactcgggaatgaactccacccctgttggtgtggttgcgtagggcagacgaaccccgtctttacgcctctcggtctttaggggtaattctagttgcattattcccgtccactcattttctataatattctgtgcggacataacatatgcatccgtcaatcataccaccgcacatatttgtgtcatatctcctgtctgcttttgtctaaatgatgtagtcatcttccagcttgcattggccgtggataacgcttttgttgatgtatgccattgatttggttggcaagacaaagactaacgtcggatatactgattttgtatctatatcgatcgagtgtcatttattgggctcaagtggatcaggttagaatgaacagtgttgaagtggccgtttgctctctttgcatttcaaatatgtttcgatctttgtagcatgcaagtgctcattagtatgtaagtgacggcattcgcttgtgtatatatagggcattgatatatacacccgtgggtctgaaatgcctccactctatttgcaaagcagctgctatacgatatataacgccaatagaggtttacttctatagatcctacacatgtgccattaggcaaagaggctcggcccaagtcatagaaaaaaaaaaaaaggcaaacccagataaagaaacgaccaagtaaggtccaaagtccctttggctatgtaacaatgtctcattgatatagaaacaggtaaaagtaacaattttgaaacacagagcgccatatattccaaggacgtctaacaactcaagaccaccaaaccacaaatcaaccctacttccgaccaccacggctaaccttagggaactcaacaggcacacgcaaacgagcaacacgacgcgcatgtgcctccgcacgtccacccttaatattccacttggcgaactccgtctcacgcggcttatcaatgcgacaaccaagctcgcggaagtactggtgaatagtattcggatcgagacgcagatcatcccggagatcagaaggatccgtggcaagctcgttaggcgcattaccacccagcgagctggagcctccatcacgcgccggctggggcgggatatgcagcgagagggcacagatagtagtgtgcaggagggtaaagtcgttcttcgagacgtagccgccgctcggcgcgaagcgacgacgcacagcatcgatcacagactccgggagcaagtcggcggaagcggagtcggccgcagcaccgggcttgggcttcgtgacggcgccggtggtgtttgagaggatgcggcggaggtcttcgcggggtgggagacgcttgctgcctgggccgccgcccttggcgcttgcgccggcgtttttcagtgagcggccgaattcgatgagcagctggatgaagcggaggacttggaggtgggtttggttgtcggagttgacgactgcgccgacacggttcgagacgtagcgtgagacggttgttacgccgagaccggcttccacttgcgatttccactcgtccacgccgttcagttggctgagggttgagtggctgcctggaacgagggtctcgattgtgtagacatcggaggggtgcgagacagcgaggttcggcgttgggaggggcttggccgcttgcacttcggcctgcatggcgagcgccttggcgtggccggatgctgtgtctgcgggcagcgaggagatgagggctgcgccggcttgcgggacggcgccggcgggggcgttggagagttgggcgttctcggccatggattgcacggccttgcgggattgtttggttccgaaggtgttggtgagggctgtgcgttgggcgcgcatggtgttctgataatgcttgttagtttggtgctgctgatatatggaattgcggaggggaggacataccatctcttcgtctgagtcttcttcctcggacttgcggcttctcactgctcctcgtagtgtagctcgccgcacctccacgaccttccatgtcttgtgctctgggtctataactgcgacgtagtgcttcacgtgcgagtcggtatcgtctcctgtgccttcacggccgacaaaatccatcttggcgtggtccgaggactggagcagcatctctgaagagacaatgcccgggttccgagtcgctgccgcagatttggagacattggcgcggcttttgatatatgggttccagcggagggattttgagctctggagaccgggtgtgtcggctatagcgcagaaattcaattagagaaagttcccagtctgcataaaaagccttcaactcaccaattaccggtgccagctcgctcttatcttcaacaacgctggcggccagcgggggcagctggtgcagcgcaggctttttgcttggacgttcattgtccgatgagcgcttgcgcttttgatctgttttactggacggcattatggcgttaaagacgagagacaaaagatcgtagctctcgagatcggctttagcgcggtgaaataaaatgtctggacttgtctggcagaaaattttacgagcggagaccaggcaggcggtgagtattacggctttccacacaaagaaatattgacgtacatggagcgtcaagctgatctggtggcgatatccagaggactacgaatatttgaggatagatactcaagacggtagctacgctctaggttacaggattacatttacaagaagtaaaacaaaagtagcactcatcaagtcatcgattcatctgcagtagctaaacgaagacctccgagttattccatggatttttgataaactcccggaagaaacctctccacaacttttgaccagcccgaaggaaggccgtaaagataatgagaattgaccagtcaccccagtgccgtgctcaaagaccgatggtttgcaccggccctccaacatccacctaaacacaggagcctctccgagtaataaccatgcatgacatcagatcgtagacgtgaatgaatccgaggtgttggaatgtgggtagactgttgttgtaacagcggattccgccaatgcgatctgcgatttcttctgaatgatggtcggaaatcttatctgtgcaagtaactcgttggaatgaggggcgtgtcacgaagaaacgaaagtcgcaaagtcgcgtcgtcaattgtcgtgttcagcgtttaaccatgagctcggcaggagagctgagatggagggggcgagtagtttatttgctgattaggaagtcagtatcacggttccccgaaggaagctcgataggcttgcgcgagactatcggcgcgcaatagagtgacttacgatctggcacgcatctttctgcgcttgcgcttgagacggcgagtgcgcttctttctccacttgtctctcatcttcactctattgactggttagtgcattgctctcgaggagaccttaagctttgggaaggatactcacgatttcgatgatgaaacagagatagtagaaagaaagatgaagtgagggcggcccgagatgactttacgtacagtgcggctgagtcagccgccctcgcttaggccccacacgtgacatttcaagcatccatctgtgacgacacatgactatgccaaattaggaaatttgatagggtttcactccatcgaggtaattgggcaaaccatttgaaaataatttatgtaacatacaaagtacgagtggagattgtagggcaatgacgttagttcaattcaacatccaagataagagcaatgccattactatgtattattgactagctatagctctaaattagaacccgtgagagttttgatgccagtgttttctcttgggtatacccagccgtatattagacatatataccacaagcttcatcactcattaagattcgcggaaccgcaagacgaggtccacaaaagtaaaaataaaaggtgcatcatacggaagtatccatcctggatattttctcagtatgtgtaccgataggtgggcgccaaatcgccgagatattcctcttcatcctcgggaatcgcagcagggtcaacaggggcgcggtcacgtttcttgttctcaaaccacagggccaccatgtagagtgtgcatgatagaccggcgaggcaaatgaacgagaggcagatgatatacccggttcggaaatctgtcacgccattctttacaacgaaagaataagtagcgatgattccaccaatattaccgaagccaacctgccatgcggttcccacgctgcgtcgatgatggccacccaagttcatggcgaaccagcatacaatgacaggcatggcgctgtaacagccgctggtgaccagaaagagtgcgccaaattgcgcgctggtactgttgtggattgtcatgagcatggcgaaaccggcaatggcgatcgccattggaatcaaggtgaaaatgaaccggtgtcgcagccggtcagaacagaaggcgattaccattgagaagccgaatgctgcagcccagggaggaatggagtacagctgggttttgatcgcactgtagccgtaggtctggataatcgatggtgcgaagtatgcatatcctgcatgagagtgagcgacgactcggaagagcatgtaaggaaaaatgatatacgtaccataagccgggacaatcaagccgaagtacataaaacctccgataaagaccttgtctgagggaagtcagcgcgctgcaatcaattgcaaaaggaggggtatagcgctgtacttacagtccttgaacacacccagaacctcgcgcttccccaagtgaacattgtgcgcagccttaccgacatccttggccaacttagcacgcatgtatgtgcgctcttcctcgttcagccacttaacatcctcggggaaatcagcaatgaaaaagaacaggatgatcgcgaccacgctggtcaaaacgccctcgattataaacacccagcgccagccactgtagccgcacatgccatccatctttgcgattccgctggcaagcagaccaccgaaggcgccggccagggaagtggagctaaagaagaaactgaaacgcttctgagcctcagagcgtgtgtaccacatgcccaacagatagaaacctggcgatcgcaattaacacctgtcgtaggagattttgttggtttttgcacttacatccagggaacatgcctgtctcaaaaacacccaaaaagaagcgggtagccatcagtccaccccagttctgtaccagaccctggaagagcaagaccaagccaaacatgaacatgcatcccgtcactgagtccgaattaacaagccgccctcaacaaaattgcgcttaatcgcacggggcgcaaacacttacaccagacatggggcttcaacttcttgagcaagatgtttgacggaatctcgaagataatatacggaacgaagaaaatagtgagcgcggtgttgtatttcgtcccatcgacgatgttcaaatcctctttaagtccaagaatagcggcattgctaatattaactctgcaggccgatgatgtcagatacaagcaatgcctggtcacacgacgcaatggtaagcttacctatccaaaaaggcaagcaagtacaaaatacacagacaaggtagaatgtgccaatcgaccttggcttgcaacctgcgcttggtggtagtcgtgagaggaggcagatcgaagtccgtggaactggtctgaccttcgcccttctcgacaggctcttgggtataggcgggttgttctgcgcggaggagtagctaattgtcagcaggagttgacaatgatgcgctggcgcgcgcagacttgctaaaccctaataacaaaacaaaaaagtcctacatgtataggattggacatacctgagacacccatgatgaaaagcgaattgcactcggggacttggaataataataacggggaagaaaaaggaaggggaaagtttagctttttgaccgaattctctcaagcgcagctcaccgcagggatgttaccgaggtgctacgcttgacaggtctcgaacgtggggtaacttccggagttacggagagcgaaagaagcgaggctgaaagagtaaattgaccttggcgagttgaaggattcgaattgcaaaggatgaatcatcccttgaatatcggtcgagcccgatctcggccactagagcaagccccatttttattatttatttattattttctcatttttgcttatttctcggaatatgtacaacatacacatactctgctagtgcaatatatgcaattagatatccatttttacaccttattttacccttttactactttactattctgtgctgagaattccctctcgtccatatccctgtttccccgcaaaatagcttggaagtcacgtgttgaataagcagatatccacatagtgcgggggtgcattttggtatttactattactattagtattagtattagtactatgataagctgaattcattcaatctgtttatgactactgtctttgactctatatactcattacggagtacggtgtagagtattagcagatatgtaatagttattaaccaaaaaataaaaataaagaagggatcttcatgtctccttggcccactggttcccactccacaagcttccagtggtccatatagccaatagtcccagccattgatcatccacaccatgaaactggacagctgaaaacccatgccggcgcccacaccctttgttgtactcttcccaattcgcacaagctttagctccacgagtgtcctcgaacacatgatcgggccgaacggcacttccttcttgatatctagcatatctagggagcttcaggaaaattcatggctttataactgcgatgcatatatctctagcttttaggaacgtgattttcggtaatttttaaaatgatagtaagatagtattctactctctttgaacttgatatatagtgctaagaagttttatcaataactattaacaaatagggagagaggatgaaagtatggttgttgagatataaacgtggaatatatcgcattgactattgttttagggtggccactcgcttgtaaaatacgttatatgaacctttgatgggacgtgacacatctaattctggctcacactggttcagcaaaacatgaacccactcaagggagtcctgtcagacttactccgtaccacttcctcatatccagataacgggagtctaatgtagcattacagaaccaaccagcatccatttccgcgtctttccctattagtttagggcgtgccaagtgcgagagcttgcctcactagcaattcagcagacttgcaggtgcctaggtattaggaaatgcgcatgattttggttgtttgctacgtatagcggttgatcgagtcagctgaccgtgaaaaggctgggctaaataaccccccttaaaacaagcatgccggctccacttgggcaacatctgacgttctggcgcgaagaaccgcgtcagaatacacaggggcttttcgaaacaagaacctttccaacttcttgtctaaaccttggcagaggaacttcaccttgctgtccatgcgttgattccagcagtccattacgtataacaactccgccacccagcatatccataaacctcaatcactttcccctccaggaccttatcaaagagatggggtgtagggggctctggaacctacacatcgatggttggtgatcgcccgtattatacggggcttgtaaacgctaacatactcttttagggaaatggtaccgcttctatcaccctcgagcgcggataagtccccctgataatgagtcgacattccgaacaatcaaaagtttatgcgataagcccgacgatcttgaaggatgggaaccagtcccgtttcctagcccaattcactcgaatctagattatgtgtacactgtcgatctagatgctggtactttcacaatctcactatggagtgagcttgaaggatccacgtcgttgacaccttcggcaacatggatggatctagccaagattcatgaggcatctagcataaatcatcatatggtgcagaatcctcagtatatgtctagtgaatatgtttgtgggagcaacgataaggcgcaagcaaagcaattcgagacgtttgaaatcgactttggcatccctacacccatgaacgagctacaggggcgattctttaccgacctcgtttttatttggcgcttctatgtcgatgacccctccacatggagacacgattctcctgtattcagggtactatgtattgctttcttgcgtcttgcggcctgggattttgaggtatctttcgattacaacgtcgagcttccaatctcattcgcgtcgattcccctttggagctaccccaacgcggacgtctattggttccatgggtaccttgttgttttacaagatgacgtcgaatccaatgccatgataaacggagccgtctcaaaagccgagtcatatattggagactccctactcagacatgacgatgttcgcttgattgtaatttcaccacgtcatgtcgctttcgtggagctttctcatgaggtcgttctgattgggaatcttgtctcagttccaccttcgctcatacagtacacaatcctttttaaccactcattctctggactagcttatggcttggaagatagctagcttctaactcgaggtcgttaataatccgaacctcaccccggggccccagggctccctccaggctccaggaatcactccctttccatggcagcctactcggtacttttggtacgtaattcgaggtgccccatatcatcaacctacccttctatcaccggtttaaattgctcatgcatggtgcctgcccaggtgcccagataatttctgatcagataagaacggatgatgaaaaataacgttcactgaaaaaaaaaaacaacaatttgagattccttcgatttagagatcgctggcagaaagaggattggtatgattggtatcataggtaccttaatggatggtggatgtcttgaaggccaggctagcaggctagtaggctagggtaactactatgtagttaacaactgatagcaggatccgggagctcttctttcttcacacaatccacttccctctctctgtggctttcagtctgttagactcaacatttctctatgtaggcaggattcttttgtcttcccaaaatgagctgaaaccaaaggcatccaaatattgttgagaaatctctctacccctatagggaatgctgtcccccagtatgtaggacactacgtggttcagctatctcgcattgtgcgttttgtgctacggcatcactccagttctgacttgtagctcccttcgatgtggtctcttctctatatgtttgcccgcgacaccagagagaacactgtccggccacgccttgatgcgggttttctgggtttagcctacttcctatgccgacgcacaaactgccttctatgcgggatgggcatactctacgtgccacctatcgattacactacacgacacctacaaggctcggagagaaagccggtcaaagtgtctcttccttccacggccgtctttatcttagcaactctgaccatcctaagttgcatttatgagactcgctagctggaccactagcagcccctttccacttcggccactcggcacttgtaagacaggtgtaaccaaatgattgctacaaagaccaagaaggtggagattttgagacaacccgagaagccatgggaatcgactttgctggttgcggtcccatccgccactaccattgacttcattgttcttatattggtgtctttcacgcccacaatagctctacccaaccaaaagaaagagatagccactgtaatattatcaatgcgaaatgtgaactattgaatctcgacagggatatccttgtctagcgtgggatcgacccgaagttggctgtcaaacaaagaattaggccgccaagtgggtttgtagacgcttagaaggaaattggaggcaaccgcgaggctttgatcataaattgtgtcaaaggctgcatgaaacttagggggcctggtcgtatatccaattggcttgatacaacctttcgtttgctattcgattccttctttctcttctccccttcatctttgccatattccatgcctgtcactccaagcgtgcactctttaatcttctggtgtatgtaattattcacatgagacagtgatttattccaatcttggttgaatcagccttcgagtcaccgtttctttgcggtttcgcttttcaccactaccacaatgagccttagaagaagaattaaagtgcaggcatccaaattcttatctactcgtcgtggatcttgtataatatttattgccttcatatggttcatcttttatcatcttccagctcccccttccacccagaacaatacccgcgcagatcgaccaccaccagaacatcaagtagaggacacgccacgattcatctaccgctccccctttcgaaacaatccggatgttcgatatgaaaagcagctatcggatgccctggagaacattgaaaaggccgtattggcccgaagtcaggaaagcaacatatccgaagataaaatctggcagatagcgaaaaatcaaaagcacaggggcgacgactcaatagtattccaagggaaaaataaggagtgggaatacaatgtaagtacttgcacctgcgaccacaagtatcttgcttgactccaactgaaactacaaagttagtcaccgatgaaaaggccatcaagttcgtaatcaacgaactatctgccatccccgaaatcgcaaccatatacaagtcctacccccacaatgtcctccgagcagacctcctcagatacctccttctctggtactatggaggcttctacgcagacatcgatgtcttccccgctcggacgatcaagacctgcccagcactagaatccttcttcacacccacacccgaggattacacacaaaatacccaccccgatgtatcactcgttgttggaatcgaagtcgacgagccttatgcctcaccacaattcatgcgcgactggcactggacaaggagctatggactcatccagtatacaatgtatgcaccgcgacgtttcagtccgctcctacgcgagactattgtgcgggttttagcacataccaggaaatacaatagtgaacataccagcctcttttcaagtccggcatatgacgagaagactatactgggggttacggggcctgatgtcttcacggatgctattctcgacacactttcctcttcgcttcctttgacacatcctctcattcaacaatcagttgaagcagatgcggatataggggatctcatctctcctacaactcaggaggtggagaaaggggtaacgtgggcgccgtttcataaactccgtgaccctgtctgcatacaggcgggtgaggctgtgccaaataaatccatgggtgggttgtgcgtgttgccaatcagtgcttgggggaacggacagagacatagtcaggctggtgggtttaatcaccccaaggcgtgtgtgaatcaccggtttgggcggacgtggaaaaaggggtggtgggagtatatatttggatgaaggtctcttatttgatctgcctttgatagtggaatataaatctctgacctaaattggatggaatcctttctcttacaatgaacctttttgcatttgtttgaatgtactacgagatggtagtagatcagattatgaaggatgcatacctagacatgtaggtattgataatgaatgtattgggaagcgaaagctattgagaaggaaagaaaggaaaggactataggaatcctttactaccacaaagaatcaaaacagcgttaacctcagcaaaagcgaaaatcctctctgttttcgcccaaaatcatttgtaacactggcacccttcctttttgggattctggcaacgggcctggttgacggaacaacctccacagaatccacacatatcaggaggataacagttgccctcacctacgacacaacttccatggtgacccacacatttggtgcaggctcggccctcaaggcctctttcctaaaataatattgttaaaaattgatcattccttataatcggggtaatcggtattatacctgcaccatgctttgctgtacggagtcagttatggtgtccaggaaatctcgaagactaaggacttactggctctccgtagatgatttcctcgccagactggtacatttctagctcgacaccatttgcagcaaaaagaccactctttgcggccgatgcattggcgataagaagggcgaggattgtagtgccttggaggaatagtttcattttggaaggaagttgctggttggaattgaagctggagggatgtattggtttgaggtatgggattgggattagacttgtacagctgaggttgatgaccaccgcggaggttcttatatcagaaattagtgattcaaaatatgttttctacccctctgttggcaatgtcaatatgcaatccttcagtttaggcgaccagcaatgcaatccttcgacttatttggtgtatgcctgccttggcgatactgggggtagaattggcattggtaaacactagtagacacagagcctcggattctgaaatagacggatgggtatcttaagatcgtcaaccaccaaacccaactcagtaatggattggccttttgctttttctgacagcacacgttgtgtttcattggccatcttcacatgtcacgcttactgttttccgttatgtctgactgcaggatttgctttattttgagtctcctgaggcccgtccgaattgaaattgggctgggccttgcgatgcgagttctcttcaaaccccctttggatgactgatacctggcccgtagccggatatttggaactctcgggaatacaaactccttatacggaacggataatttaagagttcagtattccttacacgatgataatctaaaaagactcgaaagaagagccctgctttctttttgtatgggatcgagcaagctatctacagctgctccgatgattccggtgccaagttataaggaaaagccgtagccgtcttatccgagtgatctgcggggacaaagcaacggaccgagctctagggctgaggagatgacccccagtctctgagtgcatccaatagtagctatggaacacggattggcacgaaagcaggcccaatactaaccatgcggagacaataacacacaaaacggatgcctgcatatacggcatagtaagggaattatgcagagaactgccatttatccccataaagttggaggagagccctaagtagagtgccccgcttttgtagagtgccagaccagtctgatctgcatccgacctagtaagtgtgttggatgcaacttccatcgttgttttggtcaggaattttgatattgtctggtcttacaccactgacacgctattaaggaaaaaaatatccacgggtacctaccggtactgtcacccaagtaaatcgaaaacccgtgaacccagagagagagagagctcaaataatgtgataacctgctaataaagagcaaaaatatgctactccacttctgtgacctccatttgtatctcccgtttattacttttattaccgatcctcggaacaacaatagtagttcgcggcggtgcaaatggaagcagcggtttatagagcgcctcggagtcctctgttaaatgagcccccatgttttccgtaaaataaacctacgaaacatttacatttagattcaagaattcaaaggataaatccgtgaatggtcagatcctaccgcagttttaacaatcctgtccaaaccagagcgcgccgctctatgaatcacctctatatgacgaattatccgttccgcacttgcgattgattccgaatcatacacacccacgaggcatagtcgctgtccgggctacaacgtagattgtcccgttcactttggatgcccgggactgccaggagtgggtagattactgaaatactgactggaacagttcctcctacggagccgcctcgtgctgaagagagtcgcattagtgacaggagaagccatggagattcacgtgaggtcgacctacgttcaggggctgctagggtctgtatacctttaatgacagccctacggggctggatgctatcataatccggcagattatcggcttgtcctgatgttgactgcgtggtcattttgagacgaaaagcaaagtgggataggttgtgtggtcgtaaatagtctgcatattttgccgctgataggaaggaaggacatcgcatggcgcggagtgatgtgaggggttgggcctatcacagtcccgtatagcgacacgagaaggcagggggatagggagggtttgtcttattcatttcccccacaacatgcacgactaggtacagacgaagagctggatagcatattttgatcaatgccaggagtatcaaccttccatattcgagaattctaatcatacaggtaacaggtgattctcacttctcagtcaacagaacccgtctcgctcatgctgcaggaagtacccaggttgtcacagactgactcggaatattgccactccattcctgaccactattagtcgataaagtaatgtaaatatcattactgaacgtgttctcaacaacaactgtgcgagtcccatctggattcagcgaagcaacagactgcactcctccaccattggaatacgtgtagctcccggtgccactcagcacaatggcacccggcggcataaacttgctgaattgagccatcatatagtatgctgggttgaaggtatatccaccgttggcgatagtcaccagacctcgacagtttgcacagccgccacttgacaaatgcggaccgtcttgatcatttgtacctagtgtccaggccataacgcccgatgcccaattttgcaaaggccccatggtgaaatcggctgcttggttccacgatgcggatgcgggggtccagcattctgtcatgtattgtttgatgttggggtttgtctcgtggaattgggtgagaactgtccaatctacattggcggcataacagtgccatgctaccgagtcgacatactggccagccacgttgatgacgttctgagggtaggatggcatgtctgatagccgtccgttagtagacggaatattgactcaaaattactggttctcgagagcataccggtgttgtgatcatatgcccagatatcggtgttcatgccggcttgagcgagagctggaccaacataattctggatcaactgtgcagactcgtagtcaaacatatacatcgtaggatatccagcttggctgtgcaaaggctcattttggatggtaattgcatcgatgtgggcgccgagatcttcgtaagcctggatgtacttgacgaaatactgtgcaaaggcactggcatacccagtactcccagtgcctcccctagtcaagtagccatcgttcaggttattatctttagtagtgcgatcaatcacaccgtttagcttcatccacccgggggcactccaaggagaacccagaatcttcaaacttgactgaagggacttcatcttagccagcatcgtagccatggcatttccacggtcgcccaggttaaaactagacagagatggacccgcactattcccgttatcatcataagtatacgatggatccccagagaggtcggaagcgccaatcgtatggcgcatcaaagcgaaaccagcaccagcaccggtcatcagctcgttgagcagttgttgcagcgttgagctggacagcgtgttgaaagaggtgactgtggcatcggtgacagcggctccgaagcccacaatggtttgtttgtgcccgctggatgtatcatcaatgctcagcttccaggtcgatccagaaccaggactgccactgccctggactggtggtgcaattgatgagagcttatagttgccatctgagtttgagcagtaggctgatgcagcagttgctcgctttcctggtgctgcctctgctagcaccgaaagcaagagcagaggaagaatagatggaagcatgttgtgtaatgtttcccaatatagcattttagaaattcaagattatcagtcatggggatgcaccgtccttatatgtcccactggagacgaccttgtatagactatacccggccatttttctaaaagatgaaagcaagtaacattgagggaaaataacctgagacggcaaaaaatcagtcatcccccctccctcttcagccatcagccgacgagggatactacagtaccactgactactgcacgccacaatttcccgacgggagctcgatagcttgtgttgtcttggtgaatcgactatctcggagaaatgaccctttcgaggataatacagttacttagaacggtattccccgcattcttgatgggttttataatgctattatgctactgaaataggtgagggttttgcctgggtgctttagttgcttgttcggcgcggggttgcccggaaacggcgtgaaacgccaggctgttgtggaagggttgatttaccggaacaagagatgaagcgacagccaccaatccgacctggaactttagataagagcagaggcaataattagtgtgtagatttcttaaaatgaaaaatagtatcaataatccctggctgtccaatacataacagaggagaggggatggggtcaaaagaagtatatatataacaaaaggtcaatattgttcaaactgaaaccagttattcatgtttccatcattggtaactattatactcgttgtattcgaactcgtgagttacctaggtaggttatggaagagttagggtagaaggtagccacgtgcagggtttccatgggtgaggagcttgtaaacatccatggattttgcgagggaatctgaaaattgtcagaacaatctcaaaataatgagatgaaatataagtggaacttacgagagaatgtcaacgaatataaagagagcaaagaattcaggttgttcggtgccgaaaacaggtcacctcaaccctgcccttatgacgtcaatactgggatcaggcgtctcacaagtttatagcggtgatacccccactggacttatgattttgctccttcaaacttcgtccacttgaaagaattctgaaagccagtctacaccatgagcggctacaagtttcccgtcgatctcaagcagttcaagcagcttaagcttgacccgaagaccccccagctgtcagcccaacagaagaacgatttgctacacaatatcaacattttcagagatgccatcattgccttcacagcaacgggtgccgcccgtggcgtcgcgggccacactggaggtcccttcgatacagcccccgaagtctgtatcttgcttgctttcataaatgccaaccccaacaaatgggtcgatgccctgtacgacgaggccggccaccgtgtcgccacacaatacctgctggctgcattggacggcaagatcgcgcccgatgacctgctgaactatcgtgccgccgactctcacctccccggccaccctgagctcggtctcaccccaggtatcaagttcagctctggtcgtctgggtcacatgtggggtatggtcaacggcattgctatggcaaataatgacaagaacgtcatcctgttgggatctgacgggtcccagcaagaaggaaacgacgccgaggccgcgcgaattgccgtggccagaaacctgaacgttaagctcttcatcgataacaacgatgtcacaattgccggacatccctcggaatacctaaagggctatgagatcgctcggacccttgatggacatggcttgaaggttatccgtgcccagggcgaggatctcgactccttatacggcgctatgtgcgaagtcatcaaccacgacggtcccgccgctgttgttgtcgaccgcaaaatggccgctggcatcgagggaatcgagggagaatgtcacgcccacgacgtagtccccgtcgaaatcgctcgcaaatacctcaccaagcgcgggtacagtcagcaacagcttgctttctacgacgatatcaagcctggctcaaatcctcacaagtacaagggctcgaccaaggacaagggtgcgaacaggtccattttcggtgaagccgtgaatgaaatccttgacaaactgagcaaggaggaggctaagcgtcgagttatggtcatcgactccgacttggcaggctccaccggcctgaagtccatcggcgccaagcaccccgagtccttcgtcccatctggtgtcatggagcgcggcaatttctctgctgccgctggtttcggattcggcagcaatggagagcgccaaggtgttttctctaccttctctgccttcctagagatgtgtatctccgagatcaccatggcccgtctgaacgactgcaccgttctatcgcacttctctcacagcggtgttgacgagatggccgataacacctgccacttcggtctgaaccacttctttgccgacaatgggctgatggatgcctcgatcactacgctgtacttccctgccgatggcgagcagatgaaggccgtagtcaacgaggtgttttggaacaagggcatgcgcttcattttctccacccgttccaaggtcccttacatcttgaaggagggcaccgaccagaagctctttggtgagggctacaagttcgttcccggcaaggaagaagtcatccgcaagggctccgctggttacatcgtctcgtacggtgatatgctctaccgctcgcttgatgctgtcgagaacctgcgtgcggagggcctcgatgtcggtctgattaacaagcccactctcaacgtcgtcgacgaggagaccatcaagttgtatggatcctcaccattcgttctggttgttgagtcgattgcgcagaagactggtctcggatgtcgcctgggcacacagctccttgagcgcaagttcacacccaagttcaagtccattggtgctatcaaggagggatgcggtggcctgtacgagcaagtcaatgctcagggccttggaccgagcgatatcatcgctgcagtcaaggaggtgtctggaaactagatttgcaaatgtaacgactttacacgtaataatcaagattttctcttctatttgtccactccatctttgtatatgtgactcaatttcctctcctaatcaaggccaaaatatcaggacccccacattcgtcccgccttcctaattcgatgtcgtgcaatcgaagcgacattgactcaaccggggctctccactaaattccccataatcttctgctagtcacgccgttgattggctgaactccacaaagtctgtcttggcagatgaggctagtccccaaagggcactagagcacaagagcttgaaagcacgcaatctctcaaaaggatgagaataggcctaatgcaccattaactaacactttcaggtagctagttggtttcttcaggggaaaaactatatatagcgtgtttcccgtttagcctttgacttaacgttgacaattttatcctcgtggtttgattcaaggtgcttactatctttaaccttaagccacccgggacacgccataatggccgaacgagcctctatctcggcattgtctgatacgccgattgaaaagcgagtatggtatcgcggaacactcttcaatgcctgtattatcgggggtgttggattcacagccccaggcttatggaatgccatgaatgctttgggtgctggtggcgcgcaggagcctttcttgattaatgcagccaacgcccttgtttttggtctgagtatgtggtgtcttgcggccatcacattgaaaatttcaatcgggctttgcgctaacttgcttgttagtggggattttgtgtctgttcggtggccctatcgccaaccggattggcttaagatggaccctgatgctaggcgctgtggggtatccgttgtattcgtatgtatcacaagagagaatgtgaaatattgttatcttggagctgacttctatatatagtgctgccttgtacacaaataatcgttttgtgagttcgacgttgattagaaccacctgtacagcccaaggatgaaggctaatcttgtatagggaaatgtgtggtttgtactggttggatcggtattttgtggtttatcgtgagtatcctatatctacaaaatgaaataagagcatggactaaccttcatagtgctggtctgttctgggcctctgagggtgctgtggcactgggatatcctgagcccgcaaagcggggacgatatatgaagtgagatattctacaattttatacagtggccgagtgactgacttaagaagcatctggctttggttccgtacaggtggcccgttggttggaggtgctattgtccttggcctcaacaagtatgtctaatttcaatacatttacagacggagtttgctgatgattcaaaagtgctgctgacgcccatgccaaaggaaaagttggctctggtacgttggtacgggcagactaaatgccatgaacgattgctaaaacatgacagacacatatctcatcttcatcgctctccaatgcactgccgtgcctatagccttctttctcacttcacctgacaaggttcaacgcacggatggaagtaaagtcaggattatcctgcaggactcgtggcgtgatgaaatgaaagagctctggaaggtctgccggcgaagggaggtaggtttaatatgatttcttcgtgcttgtgtggtgtacgtgactaaccttcctagattctcttgctattgcctgtcttctgggccgcgtacttcaatatgtacactggaagtatgaacccagctgtttcttcttcactgttttcaattgctgattaattggtctagacttcaaaacgtactactttggggtgcgcgctcgcgctcttattggattcgtcagtatgtttacaccctcgcattgtttgcatacgcatttgcatgagtgctaacatggagtaaagcctacttctccactcttctggcctccacactcattagtaggttcctggactaccgcggcctttcaatcagaaacagaatcaagtacaggtacagaacattgaaacttacaattaaagcgagaatacaggctgacgaagtccacagctttttctacgtgatcgtcgtccacatcgttgcctgggtctactgctgggttatccaagaaaagtacactaagaacccaccaacgcttgactgggccgacaaaggcttcgttgagggattcttcgttatcctcctctggggtgagattcgtgaatgatttaataccgcgacattgctaacccttccttcattagaattcgctcagcaatcactacaaaacttcctctactaccttctctccacaatgaccgacaacatctcagaactatgtaggttgaacccgacctgattatactatctacagattactgacaagatatagcccggttatccggtatccttcgtggccaagagagcttttcgcaggctgtctcttacggcctcaactcgaagaaatggcatggcggaagagtgccacttatcgtcaacacgattcttctaggtaagcgatacctactaaatgattataaagaagcagtgctaaccttttcttccagtcctttcagtgtggcctacttggctcgttgtcagggcccacgttcccatcgagcattccaaggagaccgctcagttgcctcaagcccaagacgaggagcataacaaagttagtgtttctgacaaggaaaactttattgttgccgaggcagttgcttcgaaataatatggattgatcaacggtcctccctgccaaagaagaattatatttacgatcagggcccgaagcgtacaaaaagctccatgattattcgaaacagtatttaattcacgaatgagaaatgcctatattctacaagtaataccgcacgaacccttacccatctttcaaaacatgagaatgccctcatcattctggctttcctcgtgcaatttccgctccgcacggcgataagtaatgggatcaaatgaacaaatagcctcgagggattcgctcagaatattgactctgtatgcattaggcacttccgtaagtcagaccccccgtttggtcatcgacttacactttcgccatattgccatacagtcgttctccgtagagctctcttaatagggttgaagtgtattggggtatctcctggtccccggtttgttggttatgcaaacaaggggatctctatggttggagagaaggcgcaagtgctataaagggtgaggaatgggaagttttgccggtcaaacccagcctggcatactgggctgcatatgaccaggatattagacttgtattgaagcttccaaggatccttatatctgtaagggcagaatagtggatcacgccaagacatgagtcgcgttcgctgagtgaacgagcgatttgaggtatgcacttgagcagtttggtaatccttgttcattgcaacaagcaagctcaaaatggccaaagctatgtagtttcccagttctaaaggggactaaattcagaggacaatgacgtacctacctaggtaggtaaacagcaaacctgactaatacagaaggcggtcagtttctgccagaaagtggggttataacgaactaaacgtccacatattttgcccttcggggcatatggtcaactgaaaatatacagagaagattagcatggcccctgcactaaggatgacacgcataatcaaagagaagctacctattttttttcctttacagaccctatattgaggttatagggtggcggcatttttgtaacctatgattggccctgcgtaaataatatatcacgtgattgacccacagccccacgtcgcaggttcgaaaccgaccaacggcgattggcaaatttattccccactcttgaatttggtcgcgataaaatagcaattatgcctactctgtatacagacccctattaagcagtgatcacgatgttgactctgaaccaagtttcccaagacgtttagccacaaatggcctcggatggggttatgtttgggtgattgcggtcatctcccagttatgtcactatttatggggccctggccagagttacggaccttactaacttattgtccacgtacataggcgtctgtgcaacggacatattgtaccacaacaatgttgagtatgcacatcatcttcaatgtgaacgaatctcagcgtgagctgcatccacccctgaccctaggggggcttgtcctagcgccgatctctcttcgacttgatcccgttacatattgcccgatcagaacttactttctgtctccagtctgtaagtgatattttcggtcaaatagacctataaacagagaaatacaggtctacatttcatccaaacaacatctcgaagttcaagggtccgacctcgggaggtccatggaccaacagcagccggacccactcttccccgcggaatttccctattgcaacgactgatcttctgagttaacggctggctgaggttgccggatcgcaatagacaagatacacatctaacaagagcccagcttccagtcgttgttttcgtgcaatcttaaggacaggacacaaatcgagtgtgctccacacctcctaggcttcgccgagggaaacctcccgcgggattcccctctgcctgggaagcactgacaaacaagatggagagtggcgacgagcgaccataccgctcccatacgaagccagcatgcgtaccgtgccggcggagaaaatcgcgatgcaaattggagccccacaccgcggcctgtctgatgtgtcgtgcgcacggcacaaagtgtacgtttcccaacggaagagcgaagtcaacaccgcagaagaggtattctacggaggcagacccaccactaccacatccaacattacgaacgccgatagcagctgcacagtcactgagccggccccctctggtcgccacttcgtcgcagttctcgattgttacacaggcccagaacgaccaggacacaccactgtctcttgaagccgaagatgataatccgcatatccttggtccagcggtgaccggggataatcatgtattggctgattacctatctaatatttcgggtggtcagggaatccgtgaaattcgccccgtcgagccaggtagttcctcgtccccggttatattcacgaaggtgcagaagcggccgctggggctcatggtgaactctagtccagcattgcataagttacagactattgaaaagcttgtagagccgtggggaccgcatctgatagacatgtgagttacatctgacattaatattcggcagaagctttggaaactgatcgttgtaccagatatctgagaaagatcaatccttgcctcccactacttgaagaaagctcctttcgggcgcaatacacaaatgccagacaccgcatttctcctgcgcttttggcatgcctatatgcccacgtgctcacccagtggcaacatgacccccttctatcacgagaaagatgcccagacgttcgttttgtatggaatcttgccattgaagcctcgtattccgagttgcatgcgtcagctgggatatcgacgataaaggctattctcctcgacgttgggggccgtccaaccacgtctatgacaggaaacggggtaagacttggctcggctatcgcgttgtgccattccctgggtttaaatcgaaacccactcccgtgggatatcccacgggaggagaagtacttaagaatgaagatctggtggtctatcttactccacgatcgctggtatgttccgagcacatccccagacaatgggacatccaaggaactcaccctctaataggtcgagtcttgcatatgggacacctccccatataagaagatcacaatacgacgtaccattaccaatatccgagtacctgtcagattgggaacgagatcacgaagcaaacgcagtttttatcgagctcatgaacttgaccgacgtgctagaccactgtctggagcaagtgtacagcatccgaatcgaaacccaaggaccaagcagaaatctagaattagagttgaacaaatgggtggactcactcacaggagacatccgcaagatcatcatccgcggctcaaacctaagcattcctggtgcctccaatctccgtctggcatatctggcaacaagactcctcctccggcgcatagacctagatcacgagcgacaagcaccagaatccaatgcagagcaaatggccaaccgtgttatggaggcccgaaggacggcggaggacattgtggttctggtccaggaacttggagaaacacaactgggtgacttttggctacctgttgtcgcgttcacattttcagcaacggtgacatttttgattcgctgcgcactagagacagatcaggccgcgggtcttgcacgaagtggctccctaagaatggcgagtgaccttttggattcgttgcgatcacatcgcaagaactttgggtgggacctgggtgatatttgcctcgcgcagcattccgatgtcatcgacaagctattgaagtcagagccaccagtcgggaactccggggagatgaatgctgaacttcgtcagcctttcatgccggatatgtcttttgttgacgatatgtttccgagcacttgggacatactgcaaattatggagtgaacgaaaatattcatgaactcattttacaacttttctatgcccatacgatatcccggcgaggctccttgtcatatatatttgtagcagtatgtaccagactgccccttggatgttgctagccgccaggagacacgggtatctttcgatttctggggtacggagtaatactaggcagacattcgggggtaaatgggcctacattcaccgctaataacttaaagaggtttagccgccgcgagacaccactggttgaaagcaagtggatgccgtctggcaaagcacgatagttcagggaacgtaagacttgctaacgtctgcggcacaaggtccacatctctcgcatttgatcatagctcctctcttccattcccgaagtgccccatagcacgaaacagtcgcatggttttcccttcctgcggctcacaaagcacaacgctcctctcgtttagataatgtgtgatcgcctgcagcgcatcatcagcctcctccttaagtaccttcgcctcaatctccatcagatgcagttctccagctactacatcatcaaacttggtcttgtgtccaccgacctgcaccttccacttcgcattctgatagggcccgtacgcacgcagcatatcccagtcgacagtcccataccgttcggcgaactgcacctgctcctcatgccagattttactatccaaaggacagcgtttttcgcaggtgaaggatggccggttaccgccatagtagtcccaggagcagtcgacaaagtctggaacaccaggaactacctccggaaagcggactttgactgtggagagtggctggcctttgttcgttttggtgcggaacattaatccggagctgatatgtatagggggatcttcgtcgtagtaggtgattggattttctttgtacgggagtgcttcatcgagtccaagctttgcaagcgtatcttgtggtgttgggtcgcaaattgcccattggaggctgatcttttcttctgcgtagacgaagggagctttcaggaagaggctgaacaagattgtccgcggtttcatggtttcgattatgggtaactaatgaagtgatggaatattattgaacggaggactgtcaggaagaatgaaggaagaaattttaagatgtgatagcaatccacatccatgcatgcaggggctcgtaggagttcggtgacgtcataatggttcgtcaggcctataaggtttaaggttaccgtcgtattcccaaggttgaacaggtccgagccccgtagggcaaccaatgcaatcagtcttagcttttccacggggtcgctttgaatgtctggaaacttgacgtgtaaggatgatctattcgttggagttgttttatcctttactcagttagaagatagcggcaaggggtgagcactaaagcggaaacggaaatccagcttgcgcggcctaaaatgcggtgtacctaggtatactaggtctatggaccgaattttaggcaacgggaataattaccccatcgggataccgcctctttatgagggcgctccgagttctgctcactgagcatctcacggcatagagtgattacttagtgggtacgtggcgattcttacctaggtagtgatgactgaatagtgttgagtgaacgctgtataaacctagtccgtacgcagcggcatctagttcggcttttcgccggtcctcctggacttttaggcttccgatgtcgaattgagagtgtcgaagctccgagataagaggtacgaggaatcgttctcttaacgatttcggtgaggctaccgatggtgcctaagacagggatttggattaagtctctcgctgtatctggaaaatcaagcgttggttttgtgattagtttatggtcaacttttctgtcaaagagagattacgatatttccatcaaattcaagcatagcagattatatggcagacgataaatatgcatgaaagaaagtggaaaaatcaaatagaggccaaattcatcatataagcagggcgagcgaaacataacctttcttcagattaaaactcctccctctgctccgcccaatcaaaatttggtagccatccaacacgatgttgagaatatagctctgcctccggcttggattgttcaagtgcatcgggtccatcgagtgttcctgccaggataacaaccatccctgggaacttttcgtgggtcttataaatagaacaaccacatttgctgcagaagtggactgtcagtttcatgccactttcgtgcatctcagtatattttatgggagatccatcggtgacacgaaacctgtcttctggaaccaacaagttcaacgtgtttgttccaccgctgatcttttgacaggaaagacagtagcatgttgcctagatataggaatagcttagttataggacttacgaaatatagtcaagctgcttaccttggttgtaggtccagatgcataatcatacttgaggtcgtgacatagacatgatcctgtaggcatcgtggctacgaatagttttacaacgggggagtttgaatgtcgacccactgattttgatatagattgaataggatcgcatatccttgaatgttgttcaaggctttctaatatatacgaattaattataaagcgtaatcctcacgtcattgtacactgaatgcccgtggcaagttgtggtagtgacgctcacctgatcattctatatcgcctgtggatgccgttcgagtcaatttgaatacgagaagtataacaaagaaaggaatggaaaaacaaggccatcaggtagagagcagggattagttagaagagaggaaccacggatgttagacccatggatcgtatagtatcgcccagccttatttcaggcccagaacaatctagtaacaagccacatatcgtgtctagaaattcaatgttaccacttgtttaattcaaccatgccaccagttcagtccggacatattagctatctagactcaggcgtctaaaaatcaaggaatttcttcaattcggaaagtggctcgccgttttatgatatacaacgttcaacacttcaagaccgactaagggagccactaaagccgcgcgattgctcaagatactttgtatacaattgacagaaatttaacctcctaggagacgctgtgtcgctcctataaacttgcatattgcttaaaaggcccagtctcttaaagctgtttctcgtcatcttaactggaagtactctaattgaatgctcctacgagcgcacaatctcatctgcgatagcaacacgttttcaacactttcatcttcacagatatgttcccaagtcgtctttcccaaaaagtgtgtatcatacagtcagtctctagactacgtagtgtcgaatgtgacatttcgctcttacaaatgattgccgagactcctatggaacgaatgcgacgatgagtattatctctcctaggaggatatacgtttcacaaggtaaattctttgtacagcgagccaaactagggtgccgtggagatatttggtgccatcgatcttttccacatgtgcgccgctctaaaggcaatgagctgttattggttacgcagcttgtgaccatgagataatcctctcgcggaaattacaccagatttaatcctggatggcgttctggttcgagccgccttgggactttgctgcgtctacttcttgatggttgcattggatacccaactgatataaatccctgttcttgtattcataataataagaaccttactaaaataactcaaatatccggtttccacgcgtagtgactgcttgtgtctgacctcagggtcctctccaagaagccctttccatccactctgcaaatgtgctggccctgactccgagatcttcccacgacatgtcatccctaggatccatcgtgccatagcatatcttctcatctggagcaacagatatccactgcatcatctgtctgatatcttcctcataccccttacccacagtggcagccacagtagcaccccactggtctagtgtgatcggatcaaagacggccttgcgggaggtggtatcactgaaaatcttcgcgaactcggcaaaagagagtttgggcccaaccactgggtacgtctttgatgccgtcttttggggacccaagcggaatatttcttggctgtcagtaagtacacaggtcgtctggagagcaagggatgcctcacctgcagcgtatacaccaatatcgtaacttgggtcaacccaatccgctagtctatccgcctcaattggagcacaaaagcggacagtgccatcatctgggttcattcgtcagtcactagtttacttcgcagtaaatgtgaagctcaccttggagttggcaatattgggaccattgcatatttgtgtaaaacagtcctataaatgaataagtagatatcccatttccagacttgtattacataccaggatgtagggcagtgacagccaagagctcatctttggcccattgctcaatcttcgatttgttgtcaaagtgaaagactttcttaaactgccggttgctggcctctgtcaaattcggcaggctactcaacacaatatgttgaactccacaggcctggatagattttcgtttcggtgtcagtccattcttatctataggcccctaggtgtctccataccttggctgcatcaatgatatttcttccggcttcaagctcatgatccatatcctcttctttgtcaatcttatgtccaggcagtcgattgttcgttactgcgaaaactccaaagacctgtttgaatgctttgaacagtgattccttgtcgtatacattggctgccactatctccaacctgtcgtcattttcgaacttcgctctgagtttcgaagcaccagcagaacaggtatctcgagttatagcacggacgtgccagcatggagcagagttcttgagaagtgcttgaaccacgccaccgccctgatttccggtcgctccaagtactgtgatcactttgacatcttcctgtgctgaagacattcttgacaacgctcaatggatatgaaaatatgacagagccgggtaagttaatttgtaaaactgcaaataattaaagacaagacacaacatttatttaatatgtctagagatgacgacactgcggaaaaacgattaagaggcttattccgtatatccgcgcctacagtgagcactaaaacggaaagggaaagtcattgtcggcctaaggatatcaccaatactggtttaacgaatcttctcccctgtctcaatcatttataaaacagttttctgtagtcgcatgcaaagcaatatctcaatcctttggttgcagtcgagactttgtggggtgaggatatctgttggccgcggagccgcggagccgcggccaagccaacatcagtagaaggtacaggatcgaacccctgcaacccattaatgaggggaacaaacagagcgaccccacagaataatgccgtgatcccacttctgctggggaaaaggactataagtcctacgcatcatccgcagatctcaacatggcccacggaatcaccacagaagaatccagtgtcgcaattatgtcctcgaagaatgacaacgatcctgttttatatatcaacgttgaccaagaagagcttcaggtcaaaacatccaagtacctcctcaactatggcaccaagttcaataaagacgttatctgtggcagcaaagggctctacgtgtacacagcctccggacacaaagtgctagattttacatccggacaaatgtcctgcctgctcggccacgggaaccctgagatcgtgcagacactcgccgaccacgcagcctccctagaccacctcttctcaggcatggtatcacccccagtgatcagcctaggcgagcgtttatgcaatcttctgccaaccggcctcgacaaagccttcttcctctccactggcggggaaagcaacgaagccgccataaagatggccaagatatacaccggaaagttcgaaatcgtcggactaggtggtagctggcacggcgtgacagcgcaagcactaggcgcacaataccacttcggtcgcaaaggccaaggccccctgatgccgggcatgctgatgcttccaccaccgaacgcataccgttccatctttcgccgcgctgacggatcctatgactgggaagccgagatggaatacggctggcgcatgatcgacatgcagtcgtgcggatcgctggcagcttgcatcgtggagtgtattcagtcgtcggctggcatgcacgtcctaccaccggggtacctcgccgctctaaagcgggaatgcgaaaagcgcggaatgctcttgattgtcgacgaagcgcagacgggcgtcggccggtgcggggatctaatggctatcaaccacgaaggtgtcgttcctgatatcctcaccctcagcaagacgctaggaaatggcctgccgctcagcgctgttgttacgagtgctgaaatcgagcgcgtgtgcattgagcgggactactgcttctacactactcatgtcaatgatccactgcctgctgctgtgggtgataaagtgcttgagattgtggtgcgtgatgggctggttgagcactctcgtgctatgggtaaagtactccatgaccggctgaatgcactgaagggaaaatatggctgtatcggagatgtccgtggacgcggacttatggcaggagttgagattgttgaggatcgtgggaccaagacccctgcgctggctttaggtaaggcgatcggggaccgggcttacgatttaggcttgtgggccaatctcagtagccatcctagctttgggggtgcctttcgtatcgccccgccaatcactattaccgaggacgagctcattagtggcttggaaatactggaagaagcttttgcaacgacccccggaactatgcctgtatgatggagggtacttctcttcattattgtactgagtttatttattttctttcaatcatcgcatcgcacctttctcacggcctatattctacgagctttacacggtcccatctcccatggatgcctgcctttgaaggcagaatgagcacttgtttgctaggtgcagcctatgaaagggctgcttttgctaggttgatgatcatagtttctcccttctctctctctccctagtagcaataacctacaacactatgctctgccgccgtgtcttacccatctagctagaatcctaatataacgggactagcatgcaaaatagatcatgcgaagactactaaaaacataatcagaaggacccaaagagcagctagaagaactatcagacaagagcaagcaaaagcatcaccgaaaagaccatcaaaaagaccatcaaaaagaccatcaaaaagaccatcaaaaagaccatcaaaaagaccatcaaaaagacatggaatgggcacataacatccatagaaatacaacatgacctcatgcttatctacatatataatgttatatttcctatttgggcttcggccaatgcactttccctcttgtacctgaaccaacaacttttccctttcacgtctcatctccccttcgcatctcgtcccccttttacatttcccatctcatctttccagttacaacagaatgcctgcactagccaatactcctaaggcctggagaagctggtacgaccaactccataagctatgaaaatcggacgatatcagtacaactgaactgaaacaactcattgatgaccctcccctcaattctgaactcaccaaagtcgcggcagaagacatgactcccactgatgtgaacgagtccttttgtcttactgaagagttcacgggcccgaggcatgacagtttgcacgtccactcattctcctccggccagatttcggtacccaaacatcctccattatacttatcaagctaacaagtatatatagaaactccgctggacacgtttaaagggccaactagccccccagggtgtaccgaagctcggtcgcgttgcaaaatacatggactgctgttgatgacctgagaatctaaaggctcgtggattcctggaagatggtccggatgttggtctccaatttgagacctccaggaggaccacgacgatcagccttgttactctctcgtggaagacgtcaccccctgctggcgcccacctgtttgcactgttacacacctttccaatcgaacaataagctccatgctcatttgaaggagtgtgcctcgagacagacagccgccgcggttgatgacgcctcggttgcgtattacgcagcgcacccaccgagtaccgacccggacgcattacccccagatctgcctatcgtaaaatccgacagacttcgcgtcgcccagccaggtatgcaatacaacctcacttgaatgggggccggttacatatcagaacaagctacacaagtgtgtcggcaaagccgactaagtttttcggcgagcgaaatcatatggcctgtcacttggtcgtatttgaggtgaagcagccttgtacgcactacgctgggataaggccaacatgtcgcacccgattgatggccaacgcaacggcaagagacccggaccttccttcatctggcggcaagatcgatatgcccaccgttgccacatggctggtcttccacttttccatccacaattattgggataacctcaagcacgaggctcgcctggctttgtcttacgttcgtctgacggacgaaggcgtgctggggtgccctaacggatggggaatgattttacttcttccggctgaataatgcgggccaatggtcttgtgtctcataccaagtacaccgcgatgtgggtcgccttgtcggccggttttactggccaacccgactattcggacaatggatcccatttcatcgctaaagaactccaatcaaggttcaaatcggttagtaccaaacatcgcacggcaccgcggagatcaccttggtcagtggggctgaccgaacggacggtcaagcaggtccttaattgcctgagagtaatctcagctagatccaccgaagtctatctaaattgggaccaatatttaccaatggtgattcaggccatcaatacccgggttatggatgcgcacggttatagcccggcacagatcatgtttggcttccaaccacgatatgccggtcatacgaacaatacctggacttcgtcaggctacatcaactcgatgcaccggggaacccacctcaatccttgccaacctctacgcttgacaacaccatgccaaatcagcaggatcttgagtcgagccttctaccgccagacctagagcttcagaagggagaaccgttgggggagttgttgactataaaggaggtcaagaagctcactgcgcaagtggtgaacagaaaacgagaccagatcttggaataccgaggctcccaagaacgaaccccttggcctcgtagggaatctagatcccctccctgtcttacagacaacacctatcccacttcgtctaatcaggagttgttggatttgttaagagaggctaaagaattgggactatctcccccatctcacgttcaggaatcttcgatttcaccatctcctccctctctttcttctttttcaacatcatctggatcttctccaactcagccattacctcgaaacgcattttcctcgaaacatacaagtcctgataccagacccccaatcctggcgcccactaccgcactttcaattatctcatctccagtgttcgcagcagccttcgacaaaattattcgcagagcagaaagaactgaaccagcgggatccaccattgtcggaaacccttcgcaagccaaaacagctgaccttacccggatcgcaaggtgcacccatggactcgtatcacgttgaaaaccagactcctcaagttgccatggctcaggcctctggacaggctgtggacatcctggatgccgacgacgacagactatcaaactgggatgagcaagacctgatgtacgaagtccagagtcaagatcagtacaccaacatgatcaaccttccagatggaatcgaatcaatttacccagttgatttaacccggcctatgacggagactctgcaacttgtatacgcaacccagggtggcaagcggccgagagaggaggacagccggactgaaagtcccccacctggtccgctggggagccatcgccaacatcattgcttatatgatagtgcgagggcatgtgactgctgcgtctcctcttcgttcaagtctctcttctacctcttccagggccccaaggattccttcccttaacatcgccgccgtcctggacgagcaggtgtttgctgcccgtcactgagcttggaagttttgctccatcgaatcgctgtgtagtcctatcagttaaccagtatattattattcaagaacagaggagatcgaaattgcgtacgaccattgcggttgaactattgaagtcatacattccctatagaaatcgatggtatcttcaaaacgcaaagaaccaaacaagcttctcgcaaaacgtacaattttgccgacgtggctaatcagaggaccagcctttgtgaaatcagattagtggaaattaaatagattatcatcacacgtacaaatcaggccttgttgattacataagagcatttaaccacctgggcactcggtcaaaagatcacagggacaatcggaacccccgattgtcactgcagcggtatatatactaggcaggtgcagctgacaaggttaacctaacactaccctctgagatcattccaactaaataaataaatattacatgatcacagtcaatggatgacatgcaatttacgatcagaattgatcgatccctgtttcgccatattgatgtttcacgtcacgtccatggaaatccagacactgttccagggctttgttccagacttttggattcatacctttatcgtggctggctactggctgcgttctaattgcgatcatctagctagcagcctattaggaccatctttgagacccgcccacgagagttgatttgtgagtggggataaccctagcccatcattggctctgaatcctcggttgatgcatagcaaccatgctgtcatcagtcatcgcatcacaaaatcgatgtgttgtttctggtaacgcaatcgtggatattgaccaattctgggcgcagagtaaagagtatgtacagaatgggaactatacgttgctgaattccaagaaaattctgattgtcttggaataattcaggaacacgcgataggaaacatggaacggggacgggtagaaagaccagttccaaagaaacaaagttgatttattggaaaagaccatgtggagcacgcggaaccaagatctcatttgcagaagcccagaaatgacccactcgcctaacgcgattggggcttcaggatgtgcttatcgggggatcatcgtgcgtagacttgggaattgagaaatccgaaagttcattgcaaggttttcaaagattttgagctccacagccttaagcatgtccactctaatgggtttgttacatatgagatccaacattccactaactctcgaccatctgcgtcgcacactcctacaatgcgacttggtctgtccgttacccagatcgcaggcgcaagcctaatcgcaggccacttcgcgagcgcattatcgccccgcacggaaatcggcgattcttacgactttgtgattgtgggaggaggtcaagctggactcgtgttgggcgctcgtctttcggaggataaaaatcatactgtgctggttcttgagtcgggcgggaatggagacgagtatcgcacgcgcataggtgcgttcaattattcgaccctgtggagtttttggcgtttctaacgctggtaaagatacaccggcatattcttactttgattcgttatggacaacgcctttgaattgggatttttacaccgttgctcagcctaatgcggacgatcgggagattaattggcctcgtggaaaggtccttggaggtttgtacaagcttcatgatattccaaagagaacaagcagcagaaagttgacacggagatataggcagttccgctatcaatgggttgtacatgacccgtccaggtgaagatgaagtcaatgcctggaaagatatgctcggagatatggacggtgccgataactggtcgtgggaatcgttttatgcagctctgaagaaaagtgaggctttcactcctcccactgacgatgtgattgacgaggctggaatcgtctggaatgcatcacatcatggtaccgacgggccgatccatacaacatacccggactagtatgccgaatcctgtcctctaaaattcgccgataaggctaacgaagtcctagcacattccccgaagtgggcgactggttagcgtcactgcagagtatgggcattgacacctctgccagtatgtacggaggtgaaaatttgggcgctgacgtctcaacctcctgcatcaacccttcaaattggacgcggtcctacagtcggtccggttatctcgatccgcttccagaccggggcaactacgatgtattggcgaatgcgcatgtaactcggctcgttttcgacaattctacatcttccgaaaagaagacagcgagtgctgttgaatacacgactgatagtgggtcgacgaaactgcaggtcaaggtaaacaaggaagtcatcctagcgggtggcactattggcagcccggctgtattgctttacagtggtatcggccccaaggacgtcctctctgaggctggtgttgacctcgtatctgaactccccggtgtcggtcaacatctccaagaccatttcgtaagactgcctcattttcaaagatggacatgcaactgacctagtcacacagagtgccacagttaaatggagtacgaatgtggacaccgcaggttctatctattacagtggcggcaaagacaaggtgcgccctgtgtatcttccttcaaataaccccatgtgctaattcctacagaatgatcccaaattcctgacatacatcgatgacgccgttgcctacgtggatgctagcactatctacggtagtaaagtcgatgagcaccagacggaattcctcgcctcaattgataaatatgcacctaaaacgacttacgatgacggcgtcctcgccggctacaaagcaatctgcaacacgacagcatcgaagatcttcaatagcccgacaggtcaaattgaaatcctatttatgaacagcgatgcaaacggtgacatcggcatcactgctgctctccaacaccctttgagccacggccgaatctacatcaactcctcgaacccaatggacttccctgtcatcgacccgaactacttcgacaacccagctggtatatacccctcaggaatatccaaggaagctttccaatactgacaataacgcagactccgagatcctcctcgcaggtatcaagctcgcccgccagctaggcgaaaccagccccatgagcataagcctcacaagcgaaacatctccaggcccaaccgtccagagcgatgaggactggatagcatggctacgcaaggaagccagcacggagttccacccgtcctcatcgtgcgcgatgctgcccgaagagcagggcggcgtggtcgacgccaatctacgcgtatacggccttaccaatgtgcgcgttgcggatgccagcatcgtccccatttccttgtcgacacacttgatgtcctcgacatacggcgtggctgagcaagcgagcgatatcattcgccgatactacaacttgccagcggagcctgagccggcatttagcgggtcgacttccgcaccttctagcagcgcggctgctgcgaagaagagtggcactcccaagagcaatggcagtcccgctagaaatggcggcgctatgtcgctcatgtggacttctcttattcttgtttttgtacatgttgttgttggcttcggcctgtatatctaggttggtgtttatattcggcgtatggtgattatcatccatgctggttggaaccggctttagcatttatgaagttcaatgtctgcgatttgtttgaaatagcgcgagaaagggacccgggagcttttcattgtgatgatagatatctttctggtacatagtccgaaatcatctcccacatagatacctgactagtacaggtagaatataaagacatccatctattgccgtgtcaaggaaattaacgataactacctcaaatctttgacttcccatctatcgccacgaaagccccatccttccttacctcaaagtccttaccctgctcccatcccacccactccctaagcgtatcaacacccccatccccaggtaaaagtcccccacccgaccaaccaccctgatccgcgggaatcggtgccgcaggcgtattaaccagatgcaccataggcctctgctcatacccatcgtcctcaagctccgcctgctccaaaacaggcgtagcacaagcatcggtgccatcaaaaacagcctcccactccgcgcgcgtcttctccttaaacctcttcgtaaagatctccctcagcaccggccactgctctcgatcctcccttttcggaagctgccccatatcaaaccctagcccgcgcaccaacgccgcataaaactgcggctccaaagccccgacggcgaaataccgcccggcatccttagtttcgtacgtatcatagtacggacacccaccatcaagcaggttctcgccacgcggctccgaccacgcgggagtgttcctccctaaccgcgggaacgtagcaaggtacgccgagccatccaccatatttgcctcgacgacctggccgcgaccagtatgagagcgggagatgagcgcaagtagaattccctggaaacagactgcgccgccgccggcgaagtcgccgaggatgtttcccggggcgtggggcttttcccctgtgcggccgagcatggacagcacgcctgagacggcgatgtagtttatgtcgtggccggccatatctttgtatttcccgtcgcggcggaagccagtcatacgcgcgacgattaggcggggattgtgctttaggaggacttctgttggggagaggccgaggcgttcgagcacgcctgggcggaaggggtcgattaggatgtccgctgctgtgaggaggcggaggaggatgtttagggaggttttatcgcgtaaatcgagtgttatggaggttttattgcgggttagttggtcgccacttatggatttgggtcggtcgatgcggaggactgaggcgccgttgtcggctagcaggagacctgtgaatgggcctggagtggttgttagttgtggtaatgacgtttcttagattgatcgcgtacctggggctaggcctgctagctcaatgactttgattcctttcaatggtgacattttgtcgggttgaacaattgttgaaggtcaggttcgaactgaggttggcatttaatagttctccgcagccgaggtccgtggatatcacagaatgcgggggggattgtgcacaaatataggtaggtaggtattgatcaccacacacttcatcaggcactattatccagctagaaagccgtcatagtatgattttacatggcagcagaataataaaaaatcgtcacatctacgatatatggatatcattcacaagggaaagcaacaatgacatcataggactatagataaatataacggattatcgtattttcgcacaaagagcatctctgtctatcgtatatagtgaaacagcaagcaaaaataaaagaaaacgagtcagactcgtcggcgacaccttggaatggatatcattaggagattgagaacaaacggaggcgaccgcaaaacttcaattcgaagacgcgatgaatcactactggccagagtaaatcacaaaagaggccaagaggtatagaatcactccagggatcggagatcgggtgaaagagaatataatataataaacacagtatcgtaatgaaaagaaaaagcaaccagtcgccagcaatcaccagttcttccttgaagtcaacatcgtgagatcaatcatatcgcatagatgatgagatcatgttgtccaaacaagtggacagtttcacagcatcatgaacatggaaagagcgacggcgagaacgccaccgaagaagccggtcacgttggaacgcgatgcagcaccagtgtagaccggggagacgccctctgggttgctgctgggggctgcgggtgtgttcgtcccggtggtggtgggaacagcagtgcgcgagggcgaggggtggaaaactatgctggatgacggtctgccgacgtggaaacctccggctccattgctgggaatggacttggaagaaggagatggcacctcggggccgacgccaggcactgtaacttcgccggtggagccagagccaggattggaaccggaatcagagtcctcaccgtttccagaagagtcagagccagagccagagccagagccagcaccggggatagcggcagtagcagtgggaactgggatggtcagggtgatggtgctaccagtaggaccacagtggttgcagacagtcacagtggtggtgtatccctcaggcaccgaaggggcggtgggctgcgacacaacctcagaggtagtagtggcagcgggcttggttagggtcacggtagtcggggtagcggcgcactgagtgcagacagtcacggtagtagtccagccttcaggaatggaagcagtggaagtggcagggccagaagtaggagcagtgatctcagcggtgccagttggggtggcagtagcagaggagtcaccagggcagtaggtcttggtaatagtggtggtgatggtggtgaaaccagttgggcaaatatcaatgtaggaggtcacaataatagttgtggtggtacccggagccaaagaggaaggcgaggcagtcacggagggagcggcagtgatacccgccggggcggtggtggagtcgctgccggtgggcttggagcctccggtactgttgtcccctgtaggcttggaacccccagtgctctcatcgctggtagacgggacaccggtcgggatgacaccttcggtagtggaagaggcgccagactcggtcgcggaagagacgggagcagtgctagaggtgtggccggagaccagcggagtagagcttggaacagtgtgggtacgggtatgggtgtgtgtgtgggagccatgtccatggccatggccagggcgcgagctgtgggtgggctttccagtggcggaggggtgtggagtgggataccccgaaggagacgaagcaccaggagtcacagtgctgctaggaacgcttgaagtggaagactggccagaggtggtaggggtgctggaagaggccacggagctggaagaggccacggagctggaagaggccacggagctggaagaggccacggagctggaagaggccacggagctggaagaggccacggagctggaagaggccacggagctggaagaggccacggagctggaagaaaccgaggtgaccgaagttgtagccgagctagacgggggaacagtggaagacgaaacgggagtcgcagtcgaggagtggatcggggtgacagacgaagacgggggagggggaggaggagcgcaatcgtacaggatatccttaatgtgctcggtgtatgttgatccgtcgatgacattgttgtcaccagcggtagcctcccagagcatgacaccaccaaagtgcttggggtgcttgtccatgtaagttttgacaaggggcttcacctccttaggggtcaagtagaatccagcattagcggcatccttggatgcgggaagaccgatgaagagcttggcgttgggattggcgctcttctcgatgacaccgacccagtcatcgaagttgaacttgccggtgccgtggacccagtccgcagcagagcaacccccggtgttgtaccactgaacccagatgaaatcgaagtgcgagttagcaatagcgttgccgagctgcgcatcgggaatagggcactggggagcaccggagatgtagtaggcttgctcggggctcttggtgaagtgccagcgcagacgattgatcatggcagcgtaacctggaatggatgttagagagagcatagtcaggaatttagaggatcagggcaacataccaactccgccattgtactcaatatcaaagtcgaatccatcaacagaggaagtgaggaatgggcgagggaaggccaggccagcgagtttctcagtccaccccaatgaagagatcgctgagttgtaaggaccgaaggagtaccagaggaaatccgcgaaccagactgcggtttcctcgtccgggatagactgggctgtggcagtaccaccaccgatggacagcaggattgtcttgccagcagccttgcaactagggatatcttgccatatctggtggcagccacttagcagctccgtaccagggaagaaggatccatcacactgattggcaaagttggaaccagggaagtcgcccacatgtttggggaactggttgataaacccgatgttgataatgtccgacgtggtctgttcacagaaatgcttgagccggggttggttggcaccttgtccatagtagacagcaacattattcttcagactcgcatcaacggccacagcagatgatgcaaagagtgacagggccgacacggcggcaagggacttgaacatcatggctaaaatgaatgtagtaattaaatgcaataattatacgcaacaagaatcgcttattaacctgatagaaggaatgacaggttaactcgcgaacaacgagaggacgcagacaagtatctgcttgggaattttcccaaagagctcaaaatgagtgtgttgatggtcgaaaggaaatgcaactccctgggggaaaagcagactgaaatacatcgagcgccagctgggactgtccccctccgccccctggggaagattccgacctccgacatagagcgcactaatcagaaaagagaacagagctatcaaaacgtggaaatgaaccagtgcgtgagatccggatgattccacgattcataggtcagtgccactccgactgcactccacctgtgcagggcgacccaacacaaagtcgcggagtggattcaagcttgatagttcgaacgctagactcggagaccatcaggatccgttcacacaagcgatgacgcgaacttgatatggaaactcaatgtagaagcgacatggaccggattttttactgtagcattgccagagaccaaacgcgtggtttaacatggccatacagccagtggcgtaaaagagtcccgttcgagcaaaagctggatcagccatcagccatgacaggcttttctttggggaggggtatgtgctggccccgtgcctattccggcctatctcggcgcagtaaaattgcaagagccgcatggaagaggctaaaagaccctaacggactctagcggcattagtgtcagggtcatgactggagcagaggctgttagcttgatatacaaactccaatcataactcgtgatataggcaccagggcacggacacctcggggtccaccagccatgttatgtagtcggatgcagagcattaagtccgagtgtcggaccacagataaacgtaaggttaaaaaagtggtagtaaagaagatctgtttgacaagcatcaattagaacaaaaataaacaaccttggaagtgagtgtaacgggatacaacaataccaggtgatattgaggtcgaagagtcttagagacttccaaatcgaggagatgggaaccgacggagccaaaagctaataagcctgcgctaagcccttcgggggtaagtgcggagcaggtccattccaggtacgccaatcataggcgccgatccggaaagaagccggatcaccgtttttattcggttacagcaggaacagcaggaacagcatttacggcactttgagattgttgtctcacttgatttctacttgatcgtctttagttcatctgtagttcataattagttcctctaattcgttgccttaacgaactcaagttgagatgtaactctgtgcagggtacggagtactccgtattttgtacacgttctagcccttggcccccaaaactcccacgttacaatttccttttattttccggtttatgcaaggtacaaatttgcttcggagatatgcccactctaagatgatatttagccgacaatgacgccactcatcgcgatgcctgattgctcccctttaatcttggaactgcgcactttacattccccataagcagcccccgcccccagggctccgtgaccaagattaaccgagacaattataagaccttgagatgaaagaaagtcaattccagcctagatgcaggtacagatccagcctaccatgtatatactccgtatcatggatttcatcagcgttgttgtatattaatgatgttgcgtaggcggggaccgtggacgatccctgtggaccgtaattaaaagatcctctctatagccgttccagccctatttacacgaacataacataaagccgaagaacccccgatttcgaaacctaatgcagaaatttgtttacgctgtgttagaaacaatttttgttgttggcaagcgaaatattctacttccggctgtaagggccggtaggcctacggcggtaggccggtcttccgatatgataaatctcgcttccacgctaccaagcttctagcaacagcaacaacaaagataagactatcatcccttttttatacgaagttgaaatggatactaattaaaaatatccataataggaaaaagcaaacaaacgccacccataagccacaagaccgatccagtataagcagtcgagtgggaacgaaattacggagctactcggcatggtcttctgcggaatcttggaaggttcttccggatgataatgatatggatattctaccacacgtcccactgaattctggaaatagatagtgttggttataacgtttaagcacttgatatggctatatacttccggggctgataattcacgagttcaacgaaatacaggttgctcgggaatcagaaatattcaggtcgaagtcatgaataagcagcattttatcaaaatactggatagatatccaagttgcgcggcctcacgcatttatatatccccaaggtccctcccctgagttcaatattacatatgctccaattggagagaacaagaatacatgaacatcgtccctacaattctgctaactccaagtctcgaacagatattcctataccactcattgtaattaggatgcggctctgtgctttcgtcgcatcggcaaatgatatttgctcctacgtgccgtggcgcctcctatcgaacatcatcagcaatagtcataaaaccatgccgtggcatagggggggctcttgtgctgtgtgcagtactgtctggggatatatttcggcggagatcttccggacatttattggggtactagacccttgccatgggatagacagggtacttgctttgcggctatacgaacgccctgagctaagccatgaactaaccatcaacatgcagcctcaagtggagttcgcttagggagacttaacttacagaccgtaaggggttccattattttgagtgtcgtattatgcgagggtccccataatgggccagttaagggggatttctttttcctttttttttttactcatataacatactcaatgaggacaataagaatgggtcaaaggtgcgacggtctaattactacgtcttcctcgccgaaaaacaacggaccctcaaaaccataatatcggacttctcgagtttaagcctccttcacgcgttcgcgctctgcttccgattcaattttccatgtttctgcctcggttattccgattggccagtcccagtctcatccatgatcagatccaccagctcttgaggcaaatttaagcaaaggttccatgatcgccaggacagactctcgcaccatgcatgctgttgtggagggacatttcgagtggaacagatccgataatgcgggccaactagataagggtaatgcatctttgatgaccaggacgggtggcatcttcaagcgagaaaggccggattttgcgtcgaagagtgttgggccaggctaggaatcaaccttgaggtgtggccatagagcctaacctaggtagtcacatgaccttgctgcaacctgcttcagagctcgagccacagcacgagtccgacatgtccctgatgcgacaagtaccagcgagccatggcatcaaacgtcgcgcgtcatcttaaggatgtggaggaagaggctttcattcaagtgaacactctgcttcttgatcatctgaacacgcaagtcaaatcatgcccccctggggatatgaccgacttgctagagcataaggctaaaacatatcctgcactacggaaattgtttcgtgattcttctgtgcagtcagcaaccgaaagctggactgctccgatgacaagagtgtggtcgatgaaagaactgaattccaacttccaaccaatccgacgatcatacgaccactaagtgcaactgcgtcacgggcagcactggaggattctgatgaagatgggccttgtactgatgtacctgccattatcggaggtcttaacagattggtggcaactagtgaggtcatttggcaccttgggtcaactgcagtgctgggtctcaattcggagatcgtgatgaaaatcggcaatgatatcgacataggtcatatccacactctagaatacatcaagcaccatgcaccgcgcgttccaataccagatatacatggtatccttcaacagcctaacagcaaccgcattttcttcctcatgtcacgagcgcctggcgagcccctggattcaaaatgggagtttctaggcgaaaacgagaaatcttcaattagagaacaattggatacgattgtcggttactttcggtttctgcctgctccagtcaccgacgagacccaggctgtccttggtggcggtagtcctcgccggtgcaaagatgcacgacgagaagtccgtgtcgctcaaggatgcattagcaacgagcgccagtttaacgaatttctcacttcccaccctcatcgagctcaagctggtagcatctctatgattaaatcctatctcacggatgatcacaaagtttttctggcccatggtgattttcatccacgaaatatcatggtacttactcgcctaaatgacccggttgcggatggtgccctgcccaaagagtcactctgcaccacaaacggcaccgtcaatcaatcgaccactcgaattaccatcactgggattcttgactgggaaatgtgtggctggtacccggagtactgggaatatgtgaaggccctaaatactattactcccgggagcgatttgggtgactggtgggcttatcttccacagaaaattggtatatggcccagagagcatgcggttgacttgatgctaagcagatggcacggctgagatggtatttcgtttgaataaacattgaattttcaagataatcccggacatggatcgctcggccacgaactctcctgtacttcgtgcgcgctaactagaatatgtgactacccaaagaaggcggtgagatatatcttctactaggcggggcgctgaccgacgaaacttttatataatcctgaaaacaattcgcactccccagatgaaataaatccagacgaatatcatggaattccctgcgccccacattcaccgtgcccaaacctttcacacccatacgattattctgctccatggtcgtggcagcaatggccttgagtttgccgaggagcttttctcatccacaacttctaagggcaagaacctagcctcctgcttacccacctaccgttgggtcttcccaacctcacgtgaccgatggagcactacgttccaagaagatatgtgctcctggtttgatgcctactccctaaacgatatccagaaaagacaggaattgcagaaggacggattgagagagtcaattctgtatattcttgatattctcgaggacgaagctaggctgctagatgggcagcttggtcatatctatcttgggggtattagccaggggatggcaaccgccgtatgggcgttctttgccggaataggaacggggcaggttcaaggaccactaggtggtcttctaggcttttgtggctggttaccatttgcgcagcagctggagggtttgctagaccaatccactcttaatggacctaggatccatcaggcacagcgcctggtatctacattcttctttgatgaaattgccggtcgtgagatgccgcaggctaatcaacctgtggacagctctgtcttatctactcctgtgtttctaagccatggagcagacgatgagtgggtatccgtggaacttggacgacaggcatcccgaattatacggacaatcatggtccgcgttgaatggcatgagttcactggagcagaaggcgaaggtcactggatcaaggagcctgaaggcttcgaccagatccttcaattccttcagacctgatttcccaaactcacgaagggctgccggtggaccgttctgtcaggaatatctgttggcgccaacaaccaaggacaagccccgatagagccctacgttaagtttcagaaagtggcccgctgtacctagtcatgaaaggataattttagttgccgcaaagggaaatgagctagcgcgcgcacttctccgacccctaccttgaagcgcgctaagtaaatataggctgatgtagatcccttgcttccatggatgtagggtgacgaggaccctaacccaacgtaacaaaacaaaacaggagggaggggaagggccccggggatattactagtatgacacctaagcgactgtccaaagcataaaatcgtggctgtgatgcttcgtgtggaaggtatatatattcatggagaaggacggcagtgaaatgcttgtaagtttaaggttttcccgaggtcacctccagggctactagaaggtgactaactgccactatggaaacccgtaggcgactacgggcacactctcatacttgctgttggcccttgtaactactttatgcatgtccaactctagccgcagttcttatcataccattcccatcgcattctcaaccccccatcacaagacttggaacatactataacaccattcgaagctgcggacctatacctacaaatgtgggaggtacaaactaccttagtattgttaaggccaaataaatgtgttataactagccctgatttattcgggaaccatgtgctcaatttaaagtgttatcgggaaagcgggacttcgacatcccatagcgaaatgctagtatatatatacatatttctctggtcaaaggttttctctaaattcctggtgctggatgtctccaatctcctcatactcatgtcatctagataggatagacgaagaacgggttctccatgtccgtcaaatccaacatggcaatttcaacctccctgcgtatcatgctcccagtttcatcaagctcctcaacgactcctaattcatgagtctttctctcttcgctggtcaaggattcagcccaagccttccgctgggcgttcctacgtttcaacaggaaccgtataatcaaaagaatcaacggtgtccccacccagctgaccactatcatggaaatccaggcaccgtaatagcgaggtgcgtccctaggaacccatatctgcggtgagcaaatatttgcgatggaatagccgaccatgaacatgacatttcgggtcagctttttcgtgtagccggctgcagatgatgtagtccaacccagcgcgataatgtaggtattaccataggtgtgaccagccagcagcagacacgcaagcattcctagcttctggtcccaatcaatagcaaccatcccaattccacctgcaattgcagggatacaccagaaaagtccgtggaaggcaagatttgatggccaccaccgcagggcgtaggctcccgcaagacaaaccaggacaccaaatccgccgccagctgcagccacgagagtcgagcccaagctgtctaccccaagagctttagtaataaggttctgctgtccgtaggtgagattgttagacatcatcaaggtgaatgactgcagagtaaaaagccatgaaatggggtcacggagcgtctctctaaactggctcttcttgaactgcttctgttcaatagaactttgacttgactcgtgtactcgtttgattgtgtggattctctcttccagtgacaggaacgtagcctccgctgggttgctcggatactgaaaccagacaagaacagaaagaaggatcgagacaccccccgtaataatcatgaacagcttccagggcaggatggtgctatggctccaaagcaaaccgtaggagataaacgcggcgcatataggggcggcggcggatgtcaaccaaaggaagggttggaggaaggattgctcgtaacgattaaagaacattcctattgtgacttccattgcaggtacaaccacagactcagcagcaccgagcgccagtcgcaaaaccacaagagcggcgtaggtcgtggcgacacaatgaagtagtaggatgacaccccacatgaagactagagcggcaacaaattttccaaatggtagtttttgcatagcatagtgtcccggccattgcgccacaatgtagcctacgagagtgttagggaatatgaaataggagaaaaatactgtcacgtaccgacatagaagaaagttccaagattgttgtattgagccttggtgatgccagtttcttcgaacaggccgaggatagcggcatagccgagagtggacttgtctatctaggaaagttagagcctgcgagtaagaggtgttaatgacaaactcacaaagagcagcaggttgatagcggagagtagcccgaaaatacgccagtacaatttgcgtctcagcgttttctccttctcggtcgtcaatgaaccaacagagtctccatgaagctgaagaatgcgaagagtttcatcagcatatttggtgtcaatagctctctcgttcttaggtgattgactctctatagccataggctcagcctgaaatgtcaaatccatacgtgcgagcaactcgtttcgagccggcaataaaaagaggcctgcgccgtcgactcaagactttgaatgggtaggaaaattagaaaagagaaataaataggtcttgagttatctgccatagatttggggtactctagaatttcatcacgccataatttagataaaaacgtatccctcgttctcggctttagaaataggatcgatcaatacaagacgatcataattgccattgcaaagacgccaaggcacacatgagccccaaattatttgcgttaggacacggtcattttttttaaatagcaacggttcgacaaagggggatgtgaagtaaggagacaagaatgagcaaggttattcgccttaggcatatagctgcctcaggcaataaactctaaatgggccatgtggggccgattcccgggccgattcccgtcgtccgccaaccttggaacctgattactactcgtcaaatccgaagggccctggcctatattgttatcttaggacacccagatccagagacccagaatcggttctacatcagtgctagccctccttttggggtatctcgttcaacttcacacctggccatccgtccgagtgaaacaccctggactcaaagtctaacgatctcttacaggcgccgctcagactcatcccaacaacaaaggacgtgatagaggacaaaacttctaatctcctatagcctgcgttgattgtattctcttttaccaattggctaataacagaaaatatttactagggacttctaaagtctgagattgcgcagggataagatcgaaattccaagccagtgcgagagaccagggctgttattatgccattgtcaagtgtgtagctctcctcttaactttggccataataagtggatgtgtcctctttggtaggaggtgatgtagctggatctgctgtctgtgaaataaagcattgttgaataccgatggacagtatcaaggcgagatggaacttctatacatagcctcaacacagggcatgaagtggggtatgagggctactgggggataatactcattggcaccagatacgaggacgaagaactaccggccttgagtgcacaatgaactcagcttctgacttgcatggcggattggatcatagcagaccactagcttatcagtgcacagccgcagtcatcctatctataattttatcagtccatggaatatcaagtccggatagatttcaaataggccaatcatcgcagggcgatcttaccaattgggcctctgcgacatagacgacctcagaaggtatccacgcattacttctgtcttttaactcatactcaatggcctgtctattctacaccaacgtagcccttatgggaagaatgaaaagaagagtaaattgttccattgttctatctatgtactgtatacaaacacaatgtctacatactcatggttcaacatcatcggatcacatctttcatagtatcaccaatagcctcagcacctccgccaccacccagcaacccctcgttcgtcgcctgaataagaacacgccgataagtaattagcgccggcgacccgttatccttcacttccaaaataagatgcaacaactgccccctcgcaacaggcttacgactaataagctccacacagcacttctcagccggcgggactgtaacctcaaccacacttccagcctcatccaaaagccgaatccccaactccccaacctcatgctgaacagaccactgtgtcgcactaggatccttgtactgataccacttaaacgtaatagaatcctccgggtccgggtcatacgatgcccgcgcatcaatccgcaccatacccccagccggcacttcgagaaccagcggcgcaggcccaacactcccattaacaacagcaacagggtgatgattcgcgcgcgccacatcccgagaaagactccactgcatgcgcgccgcgaaatcattctggaacgcgtcccgccagcgccacactgtcgcctggttcgacttgtgccggcgcccatcatgcccaacgacctcatctggcgtatcgctgaaatgtctattcgcaacgcctgccccgctcatgtccgtgcggatatatcgaccaccccaggacccgtactccgggctctcggcgacaccgagcccgttttggatcaggtacaggaacgtcggcgtgtcgccttctgggatgaacatgaaatccgggtattttgagcccagggccccgatctggatatgttctcggatccattctgcgctgatcttcgacccatctggtccgccctggtcgaagccgtaccatgcgtcgccggagatcccggtccatgcagccagtccgtactggcaccacccgtgtatggagcagatgtagaatagatctgggtaggtagcgcgcagccaggttcctgtgtcgtcttggtcggagattgcgtagatgcggaggttcgcgcggtgggtggcggctgtggtgggggaatgtgtggtttgtagtttgagaagtgcggatgcgagcacgttcgtgccgccccagcagaggatccagaggggatcgttggttggagtgaggatgcagtctagcagatgctgtgcgccttcgcttagggggatgtctgggcccacggcggtcatgccgtagctctatttgattgttaggatgtggtttggcggggagggtatgatgctggacggtacctctgcgccctttctgatgagcgatcgcatatattgggctgctggatatgggtcgtttgggtggacgtgggcattgagattgtctacgactttctcgtagccgtctattatcttgtgcatgtcctgcggacagaccttgttcttcatccaggttgaagtgcaagctaccaggccttcagtacggaactggttggcatacaataggtagcgaaccagtgactcagcatcgtcgggctcattggagatatcgctcaggatgaagacgcgcggtttggacgggaaagactggagttggtgctgcgatgccattgtcaatggtgatgatgatggctatgggaataaatgtacgaatatgttaacaaaaggaacaacagaattacaacttacgaacagaagacaccatatttggacaccactcacaaggacaaccctgaatccaattatagccactcgcatatacctaggtacatagttcggctggcgtccgagtgcggagaacccgggggaaactgccgaagtttagccggcaacactttccaaacccagtcgtaaccaccacaacggactagcccccgatgaactctctcccaagtttggttagtcgtttgcttcttcgctctgacagggaaatgcaagcgcagcatttgcagttccccccacaagaacaaccgagaatcgcaattatagccactcgtacctggcttagctgcgtgctattgcggagaagccgggggattgcccgggttcagtcaacaacacctccaaaccagcagttctaaccgccagcacagactatcctccgatgagctctgcaccaagtttggtctttagcttcgtctcattgacggggaaaagacaagcgggcatttgcagtgcccgacatcaggccatctcttgcggggctgcatctgggataatgttccccggaaaggacttgatggcgttggtcaaaacctaggtatgtatataaaagagtgggtgacacatgccggggggctgcgagtcctctttgtcgacggagtgtgtgcagtaaggtcgttgctggttcttatcaattcgtcattatgtttggcgccataaaacattccgcgctctaccaggagcttagccttcgccttctattcgttggatgtttcgtctccctgggagcgattggcttcggcttcgataattcctggtggggaggagctctggggttgacgccatttgcccggaagtatgggtctcgcaatgcctccggtgattggagtattccccctgagaagcagtctgccggtacgggcactggctcggctgggattatcttcggctgtctagcttcgccatggctgtgctcgcatctgggccggaaacccacgcttctggtgatggctgctctgctttccatcggaattgtcctcgaggcctctgctgtgacgtcgttctggcagttggtagtgggtcgcattattgtgtactcgggcattggcgtggcatctaacgtcgtgccgatgtaccagtcggaatgtgctcctgctaggatccgaggtatgtggtgttcaatataattacaaggaatgggcaatggttgttttgactctacttcccaggcgctttcttggcggcatactcattctggaatacattcggcggcttcctcgccaccctagtcgttttcttatgtcagaacatgaaaggcgaatgggcgtatttgtatgcatcggaagcccactccaactgtccagtatctggctaacccatttgaagaacagtaatcctatgccagctcctggtccccgttggaataatcatcccatacccctttctccccgaaacaccccgcttccttgtctacaaagggcgctacgaagaagcagaggctgcagtcaaggatttatacggacccaattacaatgcgagcgaggaggtccagctcctccgactccaagtcgaggaacagcgcgagctccaccacgcaacgagcatcatggactgcttccgcgggactaaccggcgccgaactatcatcgccatgggcgtccagatcctgcaacaggcgcaaggtgtctcatttatcaataattttatcgtgacattcatgaagcagctggggttcgcggacccgctgcaatacaacgtcatcgtgctagcatgcgggatcgttgcgaatttagtctctttattcacatttgacaagcttggtagacggagcagcatgtttgtcggcgcgttcttcatggctgccatgatgattggggttggcggaactacggcgaatggctacgaggttctatctccagtgacgcagaacgggtgtattgccatgcttgttctgtggtatgttttctatgcgctgtcctggggtcctggtgtgtggattctcggcggcgagattggaaccggacagctgcgcgagcggacacttctcttgtcgtcccttggcagtttcgttacctcggtgcctatcaactttgtcaatccgtacgtgcaggctgcaattgggggccggacggcgattatctatggaagtttctctgttgctgctatggtctttgtttatttctttttgccggagaccaaggatcggtcccttgaggaacttgatgagatgttccagcacaaggtggcgacaaggaagtttaaggattatgtttgtaccggcctgggtgctcagattaggcaactggaggatgaggaggatgaggcccgttcgaaatgtcggcagattgaacacgttgaggttgcgtagattgttggttggtttgcttatattaaactggcggggcgtatgaaccacaacagcaaacgtattggacaaattcatgtcaaatcgtgttgaatttcacattgagagtaaagattcgctgcataaataacaaccgggcatactatcttccactgtgttgttttattggagccacttctgattgtcatataactaaggacgtagataatacgattcacataacagtattgttgtcttacctgttattctcaatcgtagaaaggtgtatttgtagtagaagtcatatcatcattccttaaattttctctatgaaactgaaggaagcaaaaggcagctcagagaacagcaatgcactcaatctcgacatcagtattaagagggagcgttttgaccgcaacacacctgccgagtataaccgttagcaacgaatcaaaccacttatgcagacccgcgcagatgcatgcgtaagcgcaatcagtacattgcatagtacgaaaagaatcgagggaagtatatgaccccaaatgaccccaacgataagaaataaatgagcgggggtaagaactcacgtccggcagggcttcacatcaccccagtactgcatgtagacggagttcatatccgcgaaatcatccatgttggacaggaacacattgaccttgacgaccttgtcgatgttggtaccagcctcctcgaggatgtgggttaggttcttgatgcattggtgctgttcgagggcagaggtattagcaggttgaattggttcaattggggttgacctgtctcttacagtgtgggccttgacatcaccatcaatcaactttccagtggcagcgtccatcgggacagcaccggagcagtagacgacgccattggcgacaatagcctgagagtagatcccggggaggggcttgggagccttgtctgtaaggacgggggtcttggaggacattgtgagagtttctgaaaggatggagtataggctagggatgagtcaattgaggtgaagtgatgaaaaaaaaaacgcaggaattgccccccttgcgtgggggaggcgctccttatcaaccgggcagcatcaggggctatggctgcatcccacacggtcaatactaaaacgtaacaactggctctatattggccgatggcatatagccgaggaacatgaagtgactcacgagtggcttcacgagaggccccatgggtccatagaactccataatggagccgacggggggtctcactgcaacagtcctgtcgatcatttcccaaaaccggcatatagttggcttatcagcttatcagcggtatttcccccgcattgcttggatggttctccccactttccgcgtgggggtgaacttttatttgaatgggaccctgggaccccgaaagtttaggacccttgtacaacatatcttttccttattatctgtaacttcaaaatgactgcaggcgttactcaaccaccttatccgctccacgagtccgttaaagacttgttggaccccgagtatgtcgcattctataacaagcatgtcatcaataaccaacaggtgcacctgcagcccgtggaagcatcacggacaagtggtgtcttaattccgggtgcaggcccaatgctggaggtgggcaagactgaagacattaccgttcagcgacgagcaaccaagggcccagcagttcccatccgctgctttactcccaagggccaggcgcctcctggtggatggccagtgatgctgtatttccacggtggtggctgggtactgggcaacattgacacggagaacgtggtgtgctcaaatctctgtgtacgaggcaactgcgtcgtaatcacagtcgactaccggtgagtgaagaattatccgtggactatgtgatcacaccatgcatatatgaccttgagaaatttcaatctaatgtctcttattttcttctagccttgcacccgagaaccgctggccggctgcagtccatgactgctgggaagctctcctctggctgatttccgacggccctgccgcactctcagtggacgtatccaaaatcgcaaccggaggctcctccgccggcgggaaccttgccgcgattttgacacacaaggcgctgactctgtcaccgcccgttcacttccgagcccagctactgtctgttcccgtgacagacaacactgccacagtggaaaacaacgagtcatatcgtcggtacgaacggacacccgcacttccggcacttaagatgtactggtaccgcgatcactatgtccccaacgacgcggaccgcacgaaccccgagtcaagcccgctgttctggcagggcgattactcgcaattgccgcctgcactggttatggttggcgagctggatgtactgcgtacggagggtgagcagtatgcggagaagttgcagaaggcgggtgtgccggttgatttgcaggtcatgaagggcatgccgcatccgtttttggctatggatggggccttgactgagggaaagaggtgtatcaccttaatgtgtgatgctcttcaaaaggccttctggacctgattgaatgtctaatataaatgtcctcctgaatacattcccgattggggacccacttattcgagcatgtcgaacaaaaggggacgcaagagggcgcgactcatgtatctatctgatattcatctgcgcctgtatgcctcgggacctgtggccagatagtttgaactggttctaattctgtttgcctagtttgtagtttattccgactgcttccattcgtcaacttctgcgttctcttgtccctttctttactttaaaatggcgactatggaattgcaaaactgtctatattcatgtttacttaatagagtgagcaggaaggaaagggtggcgataggtgagagacagcagcaaactgtgaatcacctgatcccattaataaaggcttggggccataacaaacagatggggttggcgaagaaaggaaagaatgaagaaacaaatgaaggagaagagaaagaatgaagaagacaaatgaagaagacgagaaagaaagaacggatcaagacaatcctgtacaagggaacagaaatagggacatgaacagaaacggaaataaaaaccactttcaacaaagttgtagagtgtatatactctggcccaagggcccgaacgtgtatccacattcctgcaaggcattacttagtcttcttcccttttggcacacgggcaagccagtagataaacaccgcgccgaaaatattgacgacgatgtacacccacatcagaccgaagttccgccaagcgtcagcgaagtcgctggagatttgcaggaggtaggcatcggtcttgctcaccgtgcaaaacaagcagtctgtggtagctaggggatcttccagatatccagtcccggcaattttgatataaggatccatatagtcctggcaagtttggttggctggggggttaaacttcaggaattcgactggctcgcagattgcatcggcgcccgaaacacccgtcgaaagcatcgctgagaccaagtaggtaaacggtgaaacgcggtacatgaagatccaaaatccaggcaaggcctccttagttgagagaacaccgcagaagatcaaacagagggagaacagcaaggtcgcgatgttgccaccagtctcagccagttcaatccctgcaatcaccatatgtgcgaaggttgaagtaaacaacaggaatgtccagatcaacaagaacatgagggcccctcgttcgctcactgcatcgctgggctctgcatttctgtacaatccgatcggataataccaacacaaaaagataaacacagccataagtgtattccaaggcaattccactagaatgttcgagatcatgaacgccctccaactgtatgtcttggatggacgctctcgcacctcgtaaagagagcgttgggtaacgaagtttggcatgatctgctgcaccagatttccaaaaattgtcatcaacatgaagacactgaacatctggttctggaggccttggatagaattctgggcgtggaaaaacgagaatccaatatagagcgacgtgaggatgcaaagggcagctttcgaccagatataagtcggggttcgaaagtattgcgcaaagacacgtaggagacactcccatagctggacgtaaaagggcgcggcaaattcacggaattgactaggcgaagaatcaccttgtgagtttgaagacaaggtggacttcagctcagacagatgctccttgaccttcgcgtactcgggactagcccgccatacctttggccactcaatctcgctgtgtgtacccggtgctgccccaataacgtccaacatccattcagcggggttctctccgggggtcaggtggtgggcgccgttacgttggaaatagtttgacaaagtggacgagttttcgccaatctcaccaaagtagattgtttttcccccttttgccaagaagagaagacggtcaaatcgttggaacaacatcgctgaaggttgatggatagtgcagagaatcgcctgtccgtgcttggtgagagtgtcgataaggtcaagaatagaccaagaagtctgactatccaggccactcgtaggttcatccaggaagagtaggagctggggtttcgcggcaagctccacaccaatcgtcaatctcttccgctgctcaacgttcaatccctcgcccggaacaccgacaacagcgtcagcgtacgcctccataccaaggagcttgataacctcgtcagcatagtctatcttttccttccggctaacagaggcgggttgacgtagcaaagcactaaactctagtgcttcccgaaccgtcgacgtagacaagtgcaagtcctgctgttggacatatccggtctttcgctggaaggactgatctgtggggtttccgtcaacgagcatttcgccactgacaacccccattgtaactcgcgttgctagcacgtcaagcagtgttgtttttccagccccggaaacacccatcaaggccgtacaggtcccgggcttgacccagccgtcaacattgtccagaatccttctaggctctcctttaattttgatgtcgtaacagacatcctgccagtggaagatcgcagtttgtcgctgaatggccgccgctttgggaggagactcgtccgttttgacgcctgtagaagattgagaaggtgcctccacatcactagaggcatgtttgggctgatagccacggcggaatagaaggacctcgcctttagaccttttctcggatatgtactcagtggcaagaagataggtgagcatgaagaatataaggaagccaaagagaattccaagatttctccacaaatgtcccttaagatacccgaagctctggctgagatacaacgatccagacacattggtggaccctgactgagcaccgacagttgaacagatgcgatggtccattgagacactgtcgtattgaccacctgatggaacgacagctgcacattcaaaataacgatcgtggaattcattgaccatgaaactttcaaaggcgtaggcaacgggattgatatagttcatccagcgcgaccacccgagcatattgcgagtgggaataacgaacccagtgtagataaccatacccaagatcaaaatggcagctggcactaaggcttgtgacagggatctagaagatgccgcaattgttctgaatatcattgacattgtgaacgtggtgatgaccgaaaacagccaaaatgtaaagaacgccccagcctcgcgacgtagatcggtcatgaagtataatggtatgttgaaggtcaatgagttgatcagtttgtaaggtgtatcgcagagcatcgatgcaagtgcctctgcgaaagggtggtagaaggcgtatcgggcttgcttctcaacaattggacgttgggcgtatagggtgaggatttccagtgcgctagaaaaagcattcaggaggaccgcaaaaaacaaaagagctccacgagagtagaagctggaggtatctttggggagattcacaaacaccgagccaatgatcaaagacattatgaaattcccaatcaaagctgttgcagttaggctgtagtctccacgaaggcgctgaaacccacgggtcacacagagtgaaatttgtttccgtatcgaaatggtgtatggcgatttgactctttggtgcttgtcctggatagccttacgggcatcgataaatgcatcgtaggagctacctttgagagggtaatttctctcatactcctcaatttcaaggatgagcttggcacgtgcgtcgctgttcttccatactgtcgcaaattcatcaggagtgcgaggaacaaaacgggtttcaaacccactccgcaccacgcgttccgaagggctggtgatcgacgtcaagaagtctgccgtggtttgacgctccgggcattcatagcccatgtcttcaaagtacttcctagcctccgtcgttggcccaaagtagatctgccttccttcataaagcaaggtcaccttgtcgaagacatcgtaagcgttctgtgacgcttggtagatcgcaacgcaggctgttgttcccgagtatttgctcataagagccaggtttcggcaaaactcaagtgcattcgcactatccaggcctcttgtgctgttgtcccagcactgcaacggactctgactgagagtggcctctgcaatactgacgcgtttcctctcgcctccactaactccgcgaatgaagtcattgccaacccgggtgttgatcgtatgagaaaggccaagcatggccatcaccacatctctcatatgttcagcgtattgcttgtttcccacaccctcaaggcggtttcggggagctctagctaacgccgcgaacatgagagtatcgccaacggatagttgggggaagtggacatccgtttctgctgcgtagattgcctctcccttgaaggaattctgcatgtcctttgcagagatacctaaatgcattgcgtatttgtcaaaaccttttcaaaaaatgaagttatacagaatcatgtaggaagagacttaccctgataattgagaaccgaatcctctgacatctcaataccattcatttcgccagcaatggttttgagtaacgtcgaacacccactacctggctttcccaagaccaccaatgtttccccacttttgacgagaccatcgaaatcacggaggatctggatcttctgaagcttcaggccggcgagtcggcggaccatagttccaagctccagaaccgagttcatgacgtctttttgatagtcggtgggagagccaaatccatggacgttcaaatttttgaacgaaataccagcggtccgatctgggtatttgtcggggttgcgagaccggatagccagcaacatcttcatccagtcccgcaccttgaagttggggctattgggattaagagtggattcagagtctccattggtgaacggattgttcaatgtaccgttcacagagaatcgggtagattgacgggtgagttgtcgtgctagctgaccaaccagtgcttccctgtgttcttcttcctcctgcacagtgtcttcatcctcgctcttttctggatcatggatcatgtcgagctcgtgtccacccgagagttgcattgaattgtggctgaccatcgactgggatcgagtgagatttcagttgggtatcccttagagtgatgagttgggttcgagatctacctttcgagtccctggtgacataggcttaggcaggactgttgtattgctgcgtgcttgcttgagagagaagaggaagacaagacgaaaattagagtgataggaggctgagatatctggcgacgaacgatatatatcctagtcgacgacaacaaaccgcaagcctgggagctcggcatatataagtttgtctctaaatccaaacagaaaatcccaattagatttccggcagatccggccagtttaagggtcattatcttttgtgaatacatatctagccgtgatagaagaacctccgggatgccgagatatattggcattttcaatcattaaatccgtagctatgtacatacgtaggaatgctagctatcggattttggtcttctacttccggatcccggaacggggcttatgataccccagttttcttttttccgaactataaccgtcagggctctactccgtgaaaagagtcgagaagtcgaaattgagtgtcgggttagggccgggggcttggcatgtctcaatacgcggtattaccaattaaagaacatccggcatccgatttagccacacagtgttcactaatgtggtattcattacaagacagcgtttcttgggcgatctttttccatcattagctcaaccttgagatgttcaaaggttatacatagaagaatcgctttcacaaactaagtttccttccgtcctgtttctgctgtctaaaaagaaaaacgagaagggggaagaaaatctctaaccaggcatctgaaaagcccactaaaaagacatataaaaagactattggagaagaccactgttaagaataccttgtaggtgtgagtgactcatctgatatggtatcggacttaaagaggttcgcaatttgcacaatttgcataatttgcacggttcaccagcataattatatgcaggttatccacctgggcacctcctggacccttcgctgtctttttcattctggttcggatggagcatctttgtgatatacgctaatgacttcgactctgtagctctaatttcagaaacgactcctatacctggttttacaactcgtgaacatccagaatgaatagagtgttcgacaatcaagctcacggcggctctgcattgatccaacatctacctcaactctcaaggccagaacatgggcgcctgataaaaaggaagcggaagagaaaagtgcggactccacagacacaaataaagtcatgtactaataatatcattaggcatgcgagacttgtcgacgcaggaaaataaaatgcgagattatcaaccagtccaaatgctcgttctgcagcaaagccaacgtaccttgttctctagttgatccaaggcgtcataggcagttgaagaagtaccacatcccagccaatattatttgccagtaatgaataacaatcgaacagcctgagcatgatcgatcgcctagagacaaatatccggcgcttggaatctcattttcagaagatcgggtttcacctgggtgaagatgagaacgagccatcctttatcgagggatctgagcagtcagatgaatcctcaccctcgagtgcagctgaaaatgcagattcaataaatggcacgggcgcttgggactcagaaccaatacacatggacgctcaacaagacccctctgctgctccacagaatgtatatcccaccatgctcaaaaaagccccggatgacatccacacagtaataccggaggatctgccctgcttctacgttccaaggtgttttacggatgcaccgaaccccggtaagataccatagctgattccattactgccaaaagctgattgatacgtataggcttctcagccctatcccccgaagggaagaaatggataactaataaaactcaagggggttccgttggcaacttagaatccctccttccattaggtctccaccagggaacgagtcaaaggctgcttgagggcttattccctgacaaacatttctgtccattgcccccgaaagatgagattatatcgttggtcaatgactacctgcagcagttcaactcgttgattccaatattccaaccgtcatcgctactgtcactttgtgaagacgacaacttacagagcatattcgattcgcccggtcgttgggcgagcctcaatgttgctttagcgatggggtatatgctgcgcatagagaataactcttctgtacatagtgaccgtcagaagggctggttgttcatgaagaacgccttgggggttttgaatggtctctgcttcgggttacctgatctatgggccgtccaggcgctgttagggatggtaagatgaacagcggccttgacagaagatccgactaacagtactttctgtataggttgtctttctaatggggacattgagcagccagccttgcggttacttgatttcctcggttgtgcggatatgtcatcagattcgacttgaacgcagtgaaaacgagtctggcttgtgtcctgaagaagtagaacaacggaggcggattttttggattgcgtactgtcttgacaaagagtaggggacacgctagtattgtcagatcgactttatactgacctgccctaggatatcccttcgtgctggtattccaatcgcgcaacgcgacgatgacatggacgtcttattaccaacggaaattccactggataacatagggatcatgccaacaacagaccgacaagagaccttcaacgtactcagatcaacctgtgaactggccttaatcaagagccaggtacacaaacacctctactcggtcgcagcgcgagatcgcccgcttgttgaagtggctggctcggttgccatgttggacgaaaagctccaacagtggaaggagagtattcccaccgagttccgacctgaaccaagaagggtttccacttttccacagtccccggtagccgtggtccttctttatctccatttatcatacttcaactgtctgatcgccatccatcggatcaccgcagcccaggagtcaaggctaggtatagatctggtcaaaaagagcagtgtctacactctgcccaatcaagtgatatttatgtcggaatcactgtgcacgaaagctgcaacagcgtcgattaacttgatcaaatatatgccgaaatttaacatcaccctcgttgggtacgtgatgacttggactcaaatacgtttgtccttttgcttccttgttctgtggctaatctgcaaaagggtcatgatctactaccctatttttgcatccaaaacactgtcctcgaccatcgtccggaatccgcgagacgcctcgcgcacatatcacatcgggcttatcatgcaagtggaaacatttgtgtcatccttggcccttggtaaacccaatgaagggatcgagggacttttaaaggactgcgccgagtatcgctccctggcggaggctgcagttaagaaggcttcacagatatgttggggtcgtagggggttctatgtttcttaacagcgcagtggaagatagtacgccgctcactatttacataataagtaccggatttagcctagctactactccagagaccactgaaaggtatcacagtcgaactctacaagggatgagacgtactaggggtcggtgacagtggtgcgaccgaagcccgagacctcgaatgcggtagtttggtaagcctacctatgagtcccagaaggaccagccattccacgctgtcacctccaacttcgtattataagcacgggaatatgaaaatgaggaattagagctgctggaagtaaaggggtcgtagattcaaggcaaacgccttccttaccctgaacttcctgctcctcgttcgttggtgtcttcggctcttcaccctattaatatcaccatggttacgtccttcccctaccacaacggcctgacatgtccggagatgtaaataaccatttttcctcattggttgaagcgcggtatcgagatggacagtcagcaaaccgcttgcttccgcgtcatcactagagacagttctgaaacacagctcttgtcggtcatttctgtccactccgatcccccaaggcactctgctcaatgtcctccatgtttcagacttggaacgttatctgtatccaagaaccggagcacaagagcgcatccgcaagacctgctggagacctggacttcatacgcgaaattattgaccaggggaaggtagtagcatttggaccagaaggctatgagcaagaggtcgagaatgctcggaggggaggtcaaggaggcccatgatacgtttcaaacgttgagcgggcaaaaagtgaacttgttgggcgggaaatggtatcgcgtcaggactggcgactagaatcatatctggagataagatacctcaatatccgtatatcttgttatactaacatccattagccgtcgccgatggtgtgtctcttgcacgatcaggtagcagcatatttccccaatgttgggattgttgccttccggcgtagaggctaaggaggggcatttagtttctcaagctcattagcatagtatcccatcaccatgtatagcaaagcctttcatttcggagggtggaagtagtcccagtcttttgaatagtatagaggaattcgcgtttgtagaaactcgcaacagagtatctggagatgatacatttctattccacctgcaactatcgtcagaggaaattttgaagaaacaagatagggattttacgctcttcgcttgattttccaccttccaaatgcaacaaggcaaacgccagagatcatactgctatactcagttcacagttagaccagagcattccacgatgtgaaaccatcagaaacacttcattcatgtgtcaaatgcgtcagaatgcttgtgaatccaggttcaaggctcatttctcgtccttactgacaaggtgcaccccccctcggatcacgtgtgtacagagttggtaggaactacccaaagccataaacttggaggctattaacacgaaattgaaataaaaaagagtcgtttgagtcgtttaaataagtgtataggtttaattgaaagatcgaaaggattcgtgttgatggtcggagtggttgtggttgaccacgtcacgtcatcgagggatctactcctggatagggcatcgcctccatcctatcttgaccaaggacaacccttcgatgcacgggcaattaattacactgaattcttagaagtttcattgcacttcaaatcttccaaatcttccattctcaactgaaacgaactgacgtctgtacaggcaaatccacagggataaggctgacaacaaccaaaccctcaatacatccctggcactagcaagtgcttagcattccaagttatcaagctaagatggactacccaggtacttccgtgcccgtgggctctctacagagagggccctcctcaaggcgttggattctttccatgcatccccctcggctgctacattccacccctccacgctatattcgcgtcgacgcgctccagggctaatagcccttcatcaaagtcctctttagtccatcaccactcctcttggtatcgaccttatgtatgctattatttgcgcccaattgatgaatttcgagtgagaccacaactgggctcgatttggacccggtgcatgtcctttacatacaacacactcgcattcttccctacccgtttcccaagtctcaggcagttcggagaagaccataaaagagtcgttcgtctcttggtccttgagctttcgcaatcatggcatctggattttcacctacgcctcgaaaggagggtacatggacgaagcttgtgatatttgttgcgctatacttgctgctcctcgagtccatgttggaatgggtgctcgtactctacctttacggtaatggccaggttgactcaaagatgactctcagtgttgtacttgcacttgtcgctgtacgtttgatttagccctttggttattatacagttcgctaactcttatccagtcttttctctcagtgccgcttgtcagcctccaaagcctggtcgcttggcaatacaacaatattggtggatttggaacccggaagaccattctgcataatatatgcacatatgtgctgcgcttggatcttatgctttggttagctacaagtgtggctggtctcgtggtcgctgcacagcaggtgtactgtctcccggaagggacagacgcaaccttctggagagtcggtaaaagctgtgccttccaccgagcgtcggtgatcgtgtcggtggtttcgatgtatgctcgacttttgttccatggattcttcatttgaactgacaattcttctacagggtcactgtgtgcactatgtactgtgcaaaggagctttgcgatagaccatatgatgtatcgcttcttggtatctacaagcgccagaaagttagcagagatggcagtatcggctctggtaatagctgggatagcgaggaaacgctcaaaaacgaaattctctatctttgccgccaacacgacggaactggagccggggagttctggtctgtggacccaattgccaacagagtcaactgccaccccagcgtccgacaccctgccccagcccgtctgcggcctcaacttcgagtcaacactgatcctggttcgacatatggagaaattatgcctggaaccacaatttcaccggaggacgcttcgcaccgtatctccccgggatcacaaagcctggctagcgagttttatcctctctcgagcacatctactttgaccaacgagttacgcgctcttctctctgatgcgcctgctcccaaagtcccggccattccccaggaatacacaagccataaaagaggaaagtcgtcactctcttctctcaggcgcctccttccaaaatcattcccattgtcgcttccattatcagcggatcctcaaatccaggccctggcagaccccaacaccgcatcagatgtcgaaaagcaagtcgtgacaccaaacactatgcccaagggtatccctcaatccaacacctaccaactcgtcccaaacggcaacaccccgaacgcttcttcagcatccctcccccaaagccctgccaacacccaacccaaccccaacccagtacagcaagaaggccacacccgaacaatgacaatgaactccgccgatgccccagaggtagtcccatcaaccccatccccaccaccaaaagtgcgccgctcgcaaacagccaactccatgcccgcagcccgctcaatccaccacccacaccacccaaacttcatcccacgtccccctccccaaccccaagcacgagtatattcccagtccgggcgacacgcccaagacccaaaaatgcatccagattcaatccgaaacgcaatgcaacctcaacaacccatcatccacaaccccgtccgcagctcctcctaccacttcgacccaaaccacgtcccccggcactcgcagagccagtacagcccccacccaaacaccaacggcagcagccgatatggacactactcatcccgccgggcaaaacagcgccgctacggctcagtccgatccatgccagcgccgatccctcctcgacacgacgtcgaggtaatctaccccagcacgcgtcgtccgcgcagtagtacccctgccggcgcgaatggcccgctaagctgtatcttggagatgacggacccacgtgcggtggatgatccgaggcctgtatctgtcgcttactcggagttgccgtcgaattctattgatgaaacgaaatatcgtggggcgaatcgtacgagtttgagcttttattgagatggtgtttgaatggatggaagtttggaaggagtattaatagatgtttgtctgctggtcggacgttcttttggttcaacttggtttatttcttcattttacatgatttgtattattggatagtgtgcccagtatgccagggtgatttggttactcttagtgttgttgcagttagcttttgataccaaatttaattcgttcaatgcgaagacaacattgaagtaggtagacaatacataattaaacattgaagagagaaggttgaaaggtcagtacaaagttcatttcgtagcactcggaagcaacaagatgcaaatttcgtctcaagacgagaacacaacagaccgcgaagacatgcaatttcaagatcccaaattccattccaggaagtactccaggccgctaaaagacgaatcaaaggaaacacaatgcaatccgcaacccgatatggtacatcaaccccagagaaagacaagatcaaacaatccagcccattaagccctagcctccgtagtcttaggcttctgcttctgagcatacttgtagcgataagcctgcccacttttggcatccacatcacggtctcgatcacgacgacggttttccttgccatgactctcggtcaaagaccccgatccccgacccagctccttctcgccccagctcatcatcaaagccttcgccatgcggtcacgctccttaaggagcaggtcgatgcgccgctcccactcgcgctcacgcttgtccaccgacaaagcaatgcgctggtcgaccgcagcggcggtttcgtcctttgcggcgatgatgtcttccagacgtctgagttctgatttgaagctctttcgtaggtgggtttcggaggtggcggatgaagcacgaaggcttgcaagttccgagcgtagatcagcctcgcgttgctcggtggcagtgaggaggttgcggattttgcgcattgattcggcgtgtgaggcgcgcagcgttgagactgccgttgagtgtgcggtttgcaggctgcggagttggctttgatggtttgcctccagggctgctgtgtctggtcctcttggctctgggttgagagctccacgcgctgttgggggcgagggtggtgggcttggaggttcggcgatcttgtcttcttgcaagcgggcgacggtctccagggactcggcgttccgttcttgtgattggattagatcgtgctgacacttgtttaaggctgttgtgagctcgcccactcgggttgagagtcgcgagttctcggtttcaatggttttgattagggtctggacttcagttgcctgaccacgcaggcgtgctgcttcggtatctgcggctttgtgtgcggcggataactcctggatttcttgctgaaggccggcgatacttggcgtgtctggctgttgcggttgctgcacaccttggctttccacgaacttgtccttcgacggcgagttgagtggggatgcgggattccctgggcccagatctttaatcagatcgagaatctcgctgtaggtgctatggccgctgataggcagatcagctgctgcggctttgagggcactctcctgggcttccatatgggattgaacacgggtgaggtttgcttccagcgtagtgttcttctcctccagaggacggtttttaatttccaggtcgataaagcgttcctcgaggacctgataatcattgtgcgcacgctctaattccgactcaagcttctcattttccagaccgtaatcgtcaatctgtgattggagtcgatcgatctccgagtttttctcctgtatttgtgtatccctggcccgtgtgacttccttaagcttggtgaatgtctcatccagagtttcatcgcgctttcgcacctgctcttgggaaagattgagttgctggcgcaagtgagcaatcgtctccagccgctccttgcctaaagagtcctgtgtatctctgtcttggagctgctgttgcatctcacgaatctggttcaagagaggactgagatccgttgcattcatgctcaactgccgtaatagctgctcacgctcttcatttttcttttgaagcgactgaacttgctcgcgcagcattgcctcgtcgctacctttggcgttcacctcatccaagagagaatccttgcgctgcaattctgcctggagatgacggatctgttcaccagcggaaacagcttcaagcacacgattgtgattcttctgcaattggtcatcgcgttccttcaaggcttgctgcagttgtgcaatctgctggtgaagatcctcattctgcttctctggtacatggctggaggcgtccgacaattttcggacggaaggcgatgcgggatccggggcctcgtcatcgtcggggatttcttcgataccttccaggtgagtcgaatctttgggaagagcgccagtccggtgtaacaggtgtgaaggggtcgacatatccactggtggtccgaattcactgtattccccggaatcggcttcttcttcgatggccggttgctttgatttccggaaagatcgtcgtaccgatccgtagtctacttccgcttcatcctcgtcttcatggttcgctccattttccggatcccccatcaagtatctctccatattggcagtaaagtcttccggacccccaacatcggataacttatctacatcttggtggaagggaggcagagtttcgtcaggcccatccaaggcaaaatggccgcttgggaagttgctaaaatccaaggtataatcggcaagacgcgcatcgagatctgaacctgttgggcttctaggagagcggggtcgagatattggttggatttcattgtcagaatggtattcatcatccgcagcctcgttgcgaccttggttgctactttgcgctgcgacgcgctcggttgcaggagtctgggcagttgcaggggtttgtgcggttgccggagagcccaatgggctagaaggatgctgaggaggagaggatggcatgaaaagaggcgtcaccaacgttgactgcccgatggtgtcatgtgaggtgtgaaacggcgaggtatagcctgtgttggccatggttgcgcacgcgtgcggatgcggatgcgcaaagatgagggcaacacgataaggctaaacagccaaagcagagttcaagtgcaattcttaaggttgcactggagagctaccaaatgaaaaatattaaccgagtaaatagagaaataacaataaccaaattgcgggggagaagagaaagattgaagaatctcgcgacgggttgtatttggccgcctgaggcggaaatgtttatccactgcctttttaggtctagcgggcatgtgtgtctactatgcttcttacttcttacttcttgacttctgattccgctcttgtttcacattaattatttgccatttgcatgaaattgatccttaaatcaagccattgtcttccattcttcgaatccaggtggaaccacagagggctcatgcgaccggccacgccgttcggcttctaactcggtttccccgtttcctggtgcttttctccgacctgcagcacgaccgcctttcgaagcgatagcatgctatttacgtttatacatttaactgcaggtcctttttactgtatgttggggcattctcacctgtttctctggatccatattatggaatccgcccacgccggtagcttttccacccttctttccacccttgtggcctatttctgaaagctgttcgcgtggacgattcgcaaaattcccagggttgggatgatgtgggtgttcaggcggtggtactgtggcgacactacaccgatgccacaatccgacgttcactgactgtccggatggaagcagtctggaaagtggacgtgacatgaaccgagtactaatcaaagccatcatgctgtcgaatgtgcaagttgatgttagaagtatacgctgctgcgcaagaagatgttgcttcgccacaaggctgctttgatggacatggcccgcaacttatgtagtcttcagaaacagctattttgcctccatcatctcatcggaggcgatggtggcttgtctctatgacattgcctttacgaaacccgctagtcggctagctacataccattcttgtatgactggaagaagtccacattgagatacactgtgttcctggttgttcgtttcaatttgctggagcacgaatccggtattcaagtttgatgtcatccccaggtcttcctaaacgagcccaagtccaacaccatgggtatagggactgtttcccatggttctagtattgaagctatgagcccgacatggggatgaaaagaagatgccctactagcaagttaatatcgaatttaaaccacgaaggtaggtatatggccctacttgatcccagcaacaatcatagtttcttgtagatagctggtagccttgcccaaaaaatggatcgaccattcggcttagtcaggatttgtgtttatcgtgtgcaggtgttcaatccgatctactactctgtgttgcagtaatattctctggctatttccatttttggtctggaaatttgtcattggataacaccgggggttttatttactactctgtgctcattcccttcaagcgctaggagctcgaagaatttcgaacccccacatctgccaatcgccaaagcttgagcgagtcatccagctctcacaaagcgaagctcgtgggataaacttgctataatctacgtttatctgggcattcaagtcatccccctttttgaaatgccccctatccgaggtggactcggcgagcgcccgcgggtgatcctgtaccaccaaacgctcatcccaggtgggggccagtatgtctccatgctcccgctcctggaaaacaacaccgggataacacatcttattctcgcggcttttcacctaaacggtgcaccaggagatatcactctcaacgatgacccgccagacagcgccaagttcgaccccctatgggccgaagtacccgtcatgcagcagcaaggcgtgaaagtgatgggcatgctaggcggggcggccccgggctcattcacgcgccttgacggcagccgggcggaattcgaacaattttattaccctttcctgaccatgatccgccgccatggccttgatggaatcgatctcgatgtagaagaggccatgtccttgcaaggcatcattcgactcatcgaccgactcaaggctgacatgggcgacgcatttatcatcaccttggctcctgtggcagctgcactacttggtattgggaacctatccggctttgactaccgtgagctcgagcaggctcgggcttctaagattgactggtacaatgcccagttctacaatggctggggtcttgctgaggatccacggatgtatgctgctatggtttctcaggggtggtctccgcgacggattgtgtatggcctgttgacaaacccgggtaatggatcacagggttatgtgtcccaggaaaaaattggacctgtcctggccatgttggttgagcagtttcccaacttcggtggcgttatgggttgggagtatttcaatgctctacctggaggcacggcgaaaccgtggcagtgggctgctgcgatgtcattgagtatgggcataagagatgttgtcgcggtagctcgtcagttaatgtcggcagggccgatggcgagcaccctcaataatttgtttcaagatatgctgaatcagggacatcaatgaaacacaatggatatgtatcattccagacaaactatggctaatataactacttgcacttcaaacccaacatgaagttactaggccagctgtagtgcctgggctgtacctaggtaggtactgccattgtggtttaagtgtataaatccaacttatagttaaatagtagacgccagttgtataatttacacgatttatgcaattttcaataaccaatacgatcaaatacgatcaatcttgaaacattgaaacattggagcctcttgtgttgtcgatctttcccctaaatgtgatacgtcatcatatcacgaatcaacaggaaactccatcttccactcttcaccatctccatttcttctatttagcatgcggtgatttccacattttgaaattggccatattgcttcgcataatggcctccctacggcgaattgctgtagccacgagctcggcgatcatccgcttgacgagcttcgtgtttctgcgatgggtataagaccctcccataaacagttaatatcgcgcttcagaagactcacataattatagatccctggccatcactttgtgcctctcgtgattacctctctattggtgtacctgtcatcaatattttccttgctcaaggacacccagcctcaccaaagccaaacaactacagtcagaggctcgaacagtcaggctgccctttcaaataattgcaatatgagattctaactacgtaatttacaggacataagtcaggatctagccgtgccaaaaccggcgattctggtcttaacactctgttggcagggcttccctcggcaaggtggcccctgtggaccagaatcacgatattaatcaatgtcgtcctggcagtgctaacacttgatttcctgacccgtggtgttctactttatccaaccaccgatgttgcgttctcgcgcgttggatatgtctccccgactactgccaacttggtctttcgcgagcctgacacggctcgcctaccagtgacggtcatgttccaggaggtctctgaaatgagcccggactggcacgaagaaggcatcgtttacaaactggataagaccacagactttactacgactgtgactctaaccgacctgaagccggcgacacactatcgctattcactgtctaacaacaagtctggcacgtttaccacggcgccatcgcccgaaacccgtgaatcaaagcgactatcttttgtaacgtcaagttgcctaaagccaaacttcccttacaacattctatcgcatccactacgggtcccaggcctcgagcaaatgaccgacgccctcgccaaactgcccaagctacttcgcccagcatttatgctcttcctaggcgacttcatctacatagacgtcccctggcgcttcggctcatcaatggaacactaccgcagcgagtatagacgcatctactcctccccctcctggaaccacgggccagaagaaatccgcgccattgacctcccctggctgcacactctggacgaccacgagatccaaaatgactggtcgcagggcaacaaaaccgctccatatcccgcagcagcagaccccttcatccactaccacgtgcgggcaaacccacccatcccgcaagcgcctttcgcccatccagacaacgtaacctacttcgccttcacccaaggcccagcctcattcttcatgctagacacacgcacctaccgcaccgagcctgcacaccagaactcaaccatcctcggccacccccagctccaatccctcctaacgtacatctcaaccccagagccagcaggtgtacactggaaaatcatctcctccagcgtgcccttcactaagaactggcacgtcggcaccacagatacctggggcgggttcctcgacgagcgccgcaccgtcttcgaagcaatgtggcgcgcagagcgcgagttaggtatccgcatcgtcatgcttagcggtgacagacacgaattcggtgccactaggttcccggacccggaacttaacctcggtcccgatcaacttttgcctaatacggctgggttgggattgcacgagttcagtgttgggccgttgagcatgttctacctccccgtccgtacgtaccaccagacagactctgaggatgttatggtgaagtatgcgccgaatgggaatagtaagttcgggcttattgatattgcggatgaggttgaagatgttggttcgactgctgctgcgcctgttcgggctcgtagctccgttcttacttactcgttatatgtggatggggaggttgtttggaagtatcgtctcagtgtgccattggaccgcgatatgagtgtgcatggcccgtctctgccgccgggccgtgtggttcaggatgagattccagatcttagttggagtgtggtgcttgggacggttgtgggacggttgccggagttgacaaagcggtctgttgagacagttaatgatctcttctttcaactcgcagatcgactgtggaggatcgagagactcgattaactggttttgtcgcttctccagggatcacatcgtttgctcattttgaatctgttcaaggcaggttgccttaccatattgatagatgtttccaaacaggtggcctctcaggtgcgataaattagataacacagtatttagatagcgcaacttgaatcgaattacaattcagtttctataattaatcatcaaatgaattaaatgcctagcaagccggagcgagatcgggctgtggtttttatctcgttacatagctatatggtggggaagggaagattttatacacggtttgcgctgcactgctaaaccaaaaacatgacgccgatcgactttccccgggatccattcactggggtataagatgtagacaggtggaagatggaggagagtggagaccgagtatcaatgacgcacgcgacgggagaaatgcttccgatgttgccaatatggaagattcagatgtccaactgtctcgaccactaatgaggagggatggagtaagaaacgaaagaacatcgcagagacttgattaaggaatgtctcttcgcgaatgattaagtgaatcagttgagtggcgatttggcggattccaagatgaagacaaagatgaagacgaaggcctcatagcttgacggcatcccttagaagcgtccaccgctggaacggccatggccacctcttgttgtcacctcgtcttcgctgccaccagcgactccgcccaacaagctggctccccagatgccggcgataccccacatgccaatacgccagccgcggtacaggccctgaataccctggccttgctgtcgcttctgctgtgaggtacgctggccgaggagttgtttagcacgttccgtgtcggacggtttcgagctgacaccctcctcgtaaacaacgtgccacatggtgccaatgataccgcggtatgtacgcggggtagggacgatggtttccacatcggaagcatcaatagatgtggcactgatgctaccgcccgatgacttctggcgcaggctcaaggacgtgtatgtggcgatctgggcgcggcggagcacggtctcaagcgggaatcgcacggcgagctcaagaccggagccgaggaacgcacagaggttccatgcgtttgggtttaggagggggtcaatggacagatatgatttgaggaagagtggcgtcgaggtcataatgagattcgggagacttgagtggagcacagtgattgggacgagatgcgaggggatcgtgcagttgggtgtggggagctggcggatagctcggacgagggaccccggcccatgggttgctggtgtgagcatcaggaatgtacgagcggtgtcgataggagctaggatcagggcggatagcgaggatgaaatgaatgacaagaccagcgttgccagaggggaggatgccgtcagaatgtccgccgtcatcgacattgaaatatcttcttctggcaagccgacaattgccgtcagcagactgcggatgaaagtgttcaaagtcggcaggagaagtgagtaaatgaatgtggtgttagaggacttccagagggaggttgggccactggaggaccagagctgggatagaacttcggtcagggagttcgagttcttgatagtcagagcatgcttgggctgtgcggcagactctggtcgaatatagccactgcggtcggtgatatggtggcgtggcttgcgagatctaggtgtactcggcgtgggcgttggaggggcggttgaggtgaagtaactagtttcatcatcggatgattctgagtcctatacgcaaatccgtcagtcatttgtcgtggagttcaacacagctgtatatcagctatagagaacagccttcttaccgaatcataagagcttccttcagcacccggtgtcgagttccgatcccgctgctcctctgtggcgtctggtacgacatacacctgcaagatggttttggcgacgtcgaacggctgtgcggtaagaaccttggtgtagcgcacaagagcccggttcaatgtatcccgaacccagtcagtcacagagggcgaggcttccagataatcagcatagtccaagtccggcatgagatcgcgagctgtgctgccaaacacctgggccgatgacgacgatgccacctcggcgggcgcatttgaagcgggcgataagccagacggagggatatagtaaggccgcaagggattgatcccttcacgagtcgccataatgtgatgttggtcggagttagagagtcggggaacgaagaacgggaggagtggaatggccgaacgcccaagctttgtcagtcatttttttcctccgcggccattggacgatcattgctcactcttcccatcttcccccggatcctctttttctctctttttgacttccgaattccccttttaatttattattccccttttctgcaacatgactttctggcgagaagtcggtcggcaactgcgccgtgtacctaagaccggggatatctgtttgactcaatcgcggagatgcctaagttattcaaggtcatggaccaacaccggaatcaagacacatcctcggtcggatatcaatgcacggagaagccttcaatcaccttggcaaggatataataaagcccggcgtgctttctcggtgactgcacaagctgcgcatggtcatatcacgccgccaaagcccggagaagagtaagccagatttgcactcatgctgcgctcttgtgctgtctgcgctgcatgctgacagattctttaggatcaacgtgactttcattgacaaggatggcaccaaggtagacctccaggttgctgagggtgataacctactcgacatcgcacaggcaaatgaccttgaaatggaaggtgagttgagccgatatgatgcatctttaagcacaagtatctaacatcacgccgggaataggtgcgtgcggaggatcctgcgcctgctcaacgtgccatgtgattgtggaggacccggatacctttgataaaatggaagagccatcggacgacgagaatgacatgttggatctggctttcgggcttaccgagacctctcggttgggctgccaggtgatcatgaccaaggatctcgacggactggtcgtgcgattgccgtccatgacacggaatctccaagcaagcgactttgagtcgaaataaagaccccaacagaaaccccaggagggactgtttggatcttacataccctcacatcttatctggaccgagacagctggtcacagagggggtttacggtcctatttggacaccaaatatagggctttgtactgtaatattcatctgatgcgtctagtagacttgcacggtatcacaaaatggaaatctcctgtactattttgatcgaacatgattttccacataagcacttttattacaatgtagaaaagaatatataacaaaaaaaaaagactctcccaacgccagaaacatgccatgggtaatcgtagatccagctcacgcctcttcgatgttcaaaggctttcccttctttccattgatcaattcaaggaatccttgcttgctgacctcattggcagccttctcccgctctcccataccaattgtgcccttcttgcgctcatccttggccgcctcctctcctcggacttgggccgcgcgcacagcattgaacagcttcacgacaccacgctgcgccatcttgcgcacccgcttctcctcctcggcgacggcaccagcaattcctcgctggatacccatcacatcacgaatacggccacgatccaattcctctttcttctcggcgcgcaacttggcccgcgcggcattgtcgagcttctcatccgcagcgtcgttgaccagcttggcagcatatgagcttcgcgagagaacgggatcagcccgtgcagaggtaggaagttttgtagacagaattttggaaatagaggttgagaatgcggtagggtcgttgcgcttggggacggctcggccgcgattggcgcctgtagatttgccggctggggacgagtcggaaaggtcatcttcgtcggatccaaaggcatcgctttcatcgtcatcgttctcgagatcttcatcgtccagctcgatctcctcgccgacattggagtctgcgtcgctatcgtctgaatttttcggttccggtgcaggtgcttctttttgtgtctttgccctcttcatgcgtagatcgagtgctgagggcttggtcactgtgactcctccttcttcggcgtccgagtcttcaagactgacaggattgaaattcccatcttcttcttcgtcctccgagctgctgtgatagaagcgctgcttgacgaacttcttcttgcggccagtctcgccctttaagccatcgagaaccttgcgctttttggaaaaagtaggaggcattgtcacagaaaaataatgtaataaatacaagacaagaagaaagtcaagacgctgatccaactttgccgtatcacaacttttttttggggcggtgagaaagcgtgggctctccgattggcccctccacattgcctctctggtctctcgacgggcttcatcctcacccctcctccatcgcgaaatcatagacaactacggtcttagtctcgttttctctttttaattgtttacatctacacacatactcaccatggttcttcaagaccttgggcggcgaatcaactccgccgtcaatgacctgacgaggtccaataacctcgacgagaaggtatgctatgtgttgtccagtgcggcccacaagccagcccgctaatacaataacaggcattcgatgacatgctcaaggaaatttgcgccgctcttctctccgccgatgtcaacgtccgtctagtagggactctacgcaaatcgatcaaggccagcgtgaacttcgcctccctcccagcagcagtgaacaagaagcgactgatccagaagaccgtcttcgacgagctcgtaaaattggtggacccccatgcagactcattccggccgaagaagggtcgctccaacgtgatcatgttcgtcggtctgcagggtgcgggtaagacaacaacgtgtacgaagctggctcggcactaccagacgcgaggattcaagacagcgctggtctgcgcggataccttccgtgctggtgcttttgatcagctgaagcagaatgccaccaaggctaagatcccatactatggtagtctgacgcagacggatcctgctgtcgtggccgcagagggtgtggccaagtttaagaaggagcgtttcgatatcatcatcgtcgataccagtggtcgccaccggcaagaggaggagctctttacggaaatgacacaaattcagactgccgtgacgccagaccagaccattctcgtgctcgacagcacaattggtcaagcagccgaggctcagtccgcagcgttcaaggcaaccgcagactttggagctattatcattaccaagaccgacggccatgccgccggtggtggtgccatttctgctgtcgccgccacgcacactcccattatcttcctcggtactggtgagcacatgatggatctggaacgattcgagccccgcgcgttcgttcagaagctactgggcatgggtgatgtcgccgggctggtcgagcacgtccaggccatgacgaaggattccgccggtgccaaggagacatacaagcacattgcggaaggtatctacactctgcgcgacttccgcgagaacatcacatccatcatgaagatgggcccgctgtccaagttatccggcatgatccccggtctgtctaacatgacccaaggcttggatgacgaggacggttcactgaagctacgccgcatggtttacatcttcgatagtatgactgtagccgagctggacggcgacggcaagaacttcgtcgagcagcctagccgcatggttcgtatcgcgcacggcagtggaaccaccgtccgtgaggtcgaggatttgctctcccagcaccgcatgatggccggcatggccaagcgtgttggtggccagaagaagcaaatgcagcaagctcagaacatgatgaagggtgggaacaaaaatcagcagatggctgccatgcagaagcggatggcttctatgggtggtgctggcggcggtggcatgcccggtatgcctgacatggccaagatgatgcagatgatgggaggtggtggtggtggcatgccggatatgcagagcctaatgagtcaaatgggtgggttgatgggtggaatgggaggcggtggtggtggacgtggaagaggacgttaagctcagtctttgatgatcttgccgcgtcccttcgtttcctttccctctcttttccatatcaaaccgctggctcatcaacttagcatctgggctggtgtttggcgttttcttgcttcttcacattatgtgcaacccttgtatacgagaacaatttcacatataccatcctgatagaggaatcatattccctccttgttctacatctcgaattacgattttgaaaagaaagacaagttgcagtgcggtactatcgtctcattcataataaaaccacgttgtacacataatcattaaaagagaaacgccgctaaattccatccgtctaatgaaatgagagaattcagatcgaaagcaaaggaaccaccagatcaaccactgaccatgttcatagcaaccaggagactctacaccaggcgagcccagtgagatcgaatgagaaccaatatgtcatgctttttgggtagacagagaatagatcgggccatatagatgtacacggaaccagatcgattcccatgcaaggcagggggaaaaagacaggaaggatataagacaagtccgtatgatggtacattgagcgcccgggtgaggaggggggtatgggtatcaaaaagtgtccttatggtggaggaccgaaaaaaacgcaggtaacccggacgcatgagatccacaatgaggattgtttatttttcagcgaagcgacggtcgaagtatcgcagcacacccatgacgcttgcagcctcgacttccatggcaccgcggctgtctggtggagcgatctcgcgggggtcggggagggtgtggagcttcggcaaccaggttgagatctcgtcagtggcacgagagaagttcgggtgacgagacagggtggtgaaggtatcggcacagctgagcgttaactctgagggcggagcgggcttgggtgcgggaggttgcgaaggcatggcggcgtttttacgcgagttgggcgcgctggagggggcatttcttgacatgcagcatccgccgtcctttcctccgcctccgcagcagcctcctcccgatggagttccgctcgctgaccgggaggctgccaacgtcttgcaaaaaagagtgcttcgggggtcggcttgacactgggcgcaggtgcctggcccgttggcacagggattggtcgcttggctaatgggtgggagagtcacttctgagcggacgtctccctcggatgggggtggggtaaattgggagatggattggattggcgcgagacggttggtctcgaatgtgttgatgttgcgtacacgctgctgctcctgtgcggccatctcggcgcagatacagggagtaccgtcctggcagaacccgcagggatcaacggggggcgaggagacgtcgttgtcctgagactgagtcggaacactagagaactgagcggtgaagtcgatttccatctcttccggatcgggcttgatgtggggatccctatggtcgcgttccgggctgcccacgccatgaggctcgtgtctcgaacgagatgactcgtgggtgtccattggcatgccgaacgcatcttcgatacactggcagtgggcgttggaacagttgttgcaccccagaggtacattcacctgtccatcttccttgttgcgttcagtactggtaggctgcacgtcctccattcgggagcttctggtcttgcgaggtggcaagggcacagagtctggaataggcgcgggcttgctggcgctagggccggtaagagatgacctgaattccttgacaagggcctcctttgcgctgcgctcgatcgatacttccttctccaaggcgtggcatcggtcgcgccaccagcccatctcctcgcggcactgatcaacctcaccggagaggtttccaatttgctgttggagcgaggcaacttggacatcgtggttatcttccatttccttcatttgctcttccagttcactaacacgagccgcccgacgctcacggaaggcccgttgagctgctcggttctgcgctttgcgtttggttggcggtgtgtctgtagctggcttgcgacctggcttggggcgtggtgggatgacccattctttcgaggtgatggagccgggtgtacccggtcctggcgaaggggctacggagggcctggcggccagtgtgggcgccggtgcgagggccagtgcaggaactccagctggagcaggtgccatagacacaccactggccattttgacaccaaattgatgttcaaatactatgtttgaggtcagttggaaacatggtaatcgggcgtggtcgggggcagacgcacgagccgtttctcggtcggaagagcggaagtgcgctcataagagccgataagcgagaaataccagtagagaaaagaaccagttcgctttcaagctcgtggaaaataaccaataaccagacggagaggacagaaagggtataggaaggtataggtataggaaggttaaaagcaagagaagagatgtgaagggagggggaagaaaaagtggccgatgatcagattagattatgtgctcacatgatgccggtttcggaagagctttctgtattttggagttttggtggtttttttgcttccaaggtgggatgtgggatcttctttttcttttttatactaatttaccattggtccatttgctatttcgctaaacccaatgccgcgatttccttcgaaatttttatctgatccgaatctgagtggagatggttccgagagagcgtcggtgggctgacgcaacactctttattgtacggagtacaatatacgaagtaatatattctcatatttcttcgctaactgcgtgtattgtttcttgtagatacacctcgagcatcaattgcctgaacaaagaacattgcaataccaaataatcgtgttccaattcccaattgcatactccgtaacatggctataactccctacatacacagtacaccgttcacccgatcgtcgatgactcaacgacaggcgacacggatcagaaaccctccagatggaaaaatttgctcgggtggggcgtctcgtcaatccattgaccatggatgggcaaaaccccccctacgtcccggtctcccagccctgtagccattacctagcagaaacggcgataagccaattagaacatgccagtgcgcaaaagaactttcccagaagtcatccaccagcggtgagggtatggatcgacatgggaattggatcccgtgccgttctcggtctctctgatcttatctgattgcactaatgccggttgctaggaccgcaatccaagggctaaactgataatcggcagaacctgtctttcttttattgccgtattttccctttcttggtgattgggtgaaagccttggaaatggttggtcttggccttggaagtgaccccccacagcagaatcttatcaatcagtacggagtaaatgatgccaacctcattgtgaaggccgaacagcggaactttcgtgtacatggcccgatctggagaatatcgcggctacttagtcacaaccagagatggctgtgacatggatatgcagagtttgacggaaaatatggaattcctcgaaacaattcgccgccattggacacaccatagcgttcaaaggccactattctcggcgatccgaaaagctgatccactgttctcagttatatcctttcagtgcgattatcatgaaacctgttgtctaaacttgacgacgggttgtcctcgtgagatcatcgcaaatataatagaacaatacaacatatgaaggaaccccaatttgcacttgatcttctgggatgaattactatagaacataatctatgagcggattagattccagctacagccgatcattgccgggattcggcgtttgcctccagagctctcaatttgcaagagacatagacgctacgctggtacctagaatatctccaattctcgggtaattgatttacgaaaaactaatacttcaaatgtttccagctccattgggactcaatgaagtgttcgggtcaagaatatgcatttccttccattgacgacatcagcatggccccttcccttgggaatgaatgttttcaagaggcgggtctaatgataacgtccgaagtgttattagtacaggactgatggcaaattgggagtcattctgttcaagacatccataacatcaacgtaacaaaacattcacaactccgttaattgaggagttccgtctgttgggggagcagagtgcttggtctgtacgaagaccttctgcatgcccatctctcgcttgttgaaaattgcatacaatttctccatgtcttccaaacggacccggtgggttaccatatccagtggattgatatcgttcgcttgaatgagatgcatgaggtgtttccaatacttctgcacaggagcctgtccattacccataaggtgtacgcctgtctgcatcagagccccaatgttaaagtgattggtctgagaatgacggttagatacttcactcttccgaaaaccggtgaactcacaaatccggcatagacacccgtcaccccaacgtggccaaacgggcgaacggcagtaatcatctcattcaacaactccgaggtatctgtctccatcccaagcatctgttcaaagtaatgcgcccatcctttagcgtattcgcccgctgcacattccaaagcaacatctggtccgccatcaaccattttttgcagctgtgatgtcaccgactcgcctttgggtagatcggcgaagttgattgtctcaacctttggcgctttagtcttcacaaagtccaatcgccatgcaccatcacctccgtcgataaggataactcgactagcgccatggaagaagctgaactgtgcacacatctgcccgatcggtccagctccccagatcgcaacaacatctcctttcttaacaccggtgtcgaccacgcagtgccatgatgttgccacaacatccgagacataaagtgccttctcatctggcacatcggttggaatggaaagtaggttgacgtcgccgtatggaactcgaatgtactcggcctggccacctgcaaacccacctgtaaaatgggaatatccaaatatgcctgttatccatttagtatgaaccttaggacactcaggttcaggcgaagtgcatataacttacctgcagttcgcttcccatacaaggcattggtcaaagtgttctcctgggtcctgtcacattgagaatagtactctctccgacaattcttgcaatcgccacaagcaattggaaaagaaacaacgactcgttctccaactttgatattctttgcctcgggccctacactgtccacaaccccgcagcattcatggccgagcacgtcgcccttctccaactgaggaatgacccctttgcccagcacagttgtgtcagttttcagcttgctcgcattcgcggaattatcttcataccatgatacaggtgcaggtcgctaccgcaaatagtgcttcctgtcaccttgacaatcacgtctccagggtcgatcacccgtggcttcggcatttccactgatcgcagtggtcagcaatgcatgggatcaaattgtcgcttccaaggttgcttctctcgcttaccaactttgacttgattcttcccttgccaggtagtagcctggatcatctctccggtctccaccccatattcattgtcgtagctggacacatcagtggtgattgttgcattatcaccatggccgagagccttctctaccaggtttgctgcctgggtcatcgccattttcaatctgtttcagtgaattggtatgtacgattgggatacagtggatttactcgttcactgtgtccatcggggataataaaaatctcaggatgattttgtactcattgagcagatccacattcgatcttcatttgtgatgctttctttgtaatatatctggggttggggggaatttttgtctgacatcaccatgatgccgggcgtacgtcaagcagagctatccccagtttccaggacgagaagaatagtctactctactatatatagatcctgctatatactgatcagtattatctctggcattcgtggaacaaattgagcccgtctttgcaccttgctccgggccccacgacgtcattgacttcccatagaggtcgcttggatttgtgtggccgcagtaaaaacacgaattacatcaccatgatgccgggcgtacgtcaagcagagctatccccagtttccaggacgagaagaatagtctactctactatatatagatcctgctatatactgatcagtattatctctggcattcgtggaacaaattgagcccgtctttgcaccttgctccgggccccacgacgtcattgacttcccatagaggtcgcttggatttgtgtggccgcagtaaaaacacgaattttcggactataatacttcaaagaggagtttggaggaggctaatagttgcagccaagcatacacgaaagcgttctagaccatgggagttggcgatgcgcaatagtttttcagatatatatccggatatacttgcagagtaatagtatattctatcagcgtttcaaaattacccgactgttacatcacttaagtagtgatttgcaatggaatatgaatattctcatactcgaatattatcttcgtggcagatttgctagatactagaaccgatctggtaggatcttgtagcaaatggcgtcatagggcttagtttcgatgtatgcgagcgactcataggtctaaattaaacatctaccaagcgagctaggttgttgatacttgggctagtagaatatgcctacatgtcaatatgtatcatctaacctataataaatgaatacgtcgttgtcacgcgccaatacctctggacagctgaatccgttatcacttatcaccggactcagcgataaacaagggatgggtcaggtaccagccccgtcggaactccgccttttcccctcagttctctccaactctcttccctacactcatactagcacatttacaatatgaccagaaaatacaactcggcccaaggcctcgaaacgccatggacttcgcaaatatccgcccagctgcccagttcattcatgcctgtacctgcagcacagccagtccgagctcaggcaccgatcgccgatgaacccgtccgaccagaggattactccaagccatactgcgagttcatgacatccaatcccacaattttccacgccgtcaaatccttctccaagcagctcgaagagcacggctacaagcctctctccgagagagcggtgtggacatcggagctgaaacgaggcggcaagttctacacgacccgcaacggcagctctttgatcgctttcaacattggctccaaatacgagagcggcaacggcgtggctatcgttgctggccacgtcgacgccttgactgccaagctgaagcccgtgtccaagctgccgaacaaagcaggcttccagcagctcggcgttgccccgtacgccggtggtctcggcaacacttggtgggatcgcgatcttggtatcggtggtcgagtgcttgttcgcgacccggaaaccggcaaggtggagactaagctggtcaaacttgactggcctattgctcgtgtgcctaccctcgccccccatttcggttctcctgcgaatggtccattcaaccaggaaacccaaatggtgcctgtcatcggaatagataattccgatttgtttgaaaactccaaggttgagtctagcaacacaaagtttggcacatttacctcgacccagcctgagaagcttgtgaagatcatctccaaggagcttggcatcacagattatagcactattgtcaactgggaattggaactctttgacacccagcctgctcaattaggcggtctggagaaggacatgatctttgccggccgcattgacgacaagctctgttgctatgcggcacaggaagcgctcattgcttcttcggacagcacatcgaccggaaccgtgaagatggttggtatgttcgatgatgaagagattggcagtttgctccgacagggtgctcggtcgaactttatgagcagcgtcattgagcggattaccgaggccttcgcgaaggacaactacggccccaacctcctttcccagacagtggcgaacagcttcttggtatcatcagacgtcatccacgcagtgaacccgaacttccttaatgtctacctggagaaccacgcgccacgccttaacgttggcgtggcagtgtctgccgactcaaacggacacatgactaccgacagcgtcagcgagggtgtcatgaggcgaattgcagagcgctgtgggtcaaccctgcaggtcttccagattcgcaatgactctcgcagcggtggcactattgggcccatgaccagtgcccagatcggcatgagggccattgactgcggtatcccccagctgagcatgcatagtatccgggcgactactggcagcttggaccccggtctgggtgtcaagttgttcaagggattcttcgaccactacgaagaagttgataaggagttcaccgacttttagatcgataattccacactttgctttagacagtatagagcccgttctcatttgtgcatgcttgctataggcgtgttgcctcgctattcattctcttggggcgtgtattggattacgaccaagtggcttcattctgtgactgttgctcttccatctctcggtattaagttattcgtttgattcgattgctgtacttcgactatctatatatccaagaatttccaaacctagattccatattactatatctttaaaatgacataagaacaaaaatagcgagtgtccacagccctagaggtataccgcacgggggtaattatgacccagcaaccgcaggcccaaagagcgtggtgaaaccctgacgagaaacgaaaaaggaaaaatccgacgggtatatgacgttatactccaaggcaccaagctgactgcaagagccatccaaaaaccaaatgcgtgtctatacatcaacagaccttcaaaacggcaccgctgaacccgcaggtaaaggacgaggatacgtcagattaggccgatcgcgaggctcaggaacaaacgcaatccgagctaatttcttctcttcctctctcgtccagcgcttaatactagacctgaatccagtaccaggaacaagagcgagaacccgctcggggtcaccggcaccatactcgtgttcttcaccgtgagcaccgagagttgatgcatcgccgttccagtcggagttgcgctgggttgtgtcgccgcgcgtgggacgactggcgttgaaggtcgataccattcctgggaagatgcgggcgacgaggggtttgagggttggtagacaggcgcagatgatgcctgtattgcattcgatggcggaccaggaggcagcgccgacattgtcgtctttgtgtggggttagctttgttttgggttgtgatagagctaggcgaaacgatacgtacaggtgggatcggacgattcggcgatctttttcagactgactagacggatgacactggtgacgcagacactttgtgctatgttagttctggacggttcaatctgatatctggaatttgataacttacaagccacccatagcgaacatgatcattaaagcgatcttctgttttcggggcaggtcgactgccattaaagccgggatgggaatgacgaggatggcaatatcggtcgcgatgtgcatactagcattggagaaccatagctttgttttgttcaaacagtaaccctgaattgaatcgtcccagaatttggcgacgggaatgcagtttaggaatgcactgatgaccgcccaggtgccatagatggcgaggacagtaatcatgacccagcagacgactcgcatgcggtgcgttgggaagactcggaagtactgcatcagaattgaggctttggcgcagaggacggcggcgttgtagaaaggaatggtgagccagaaggcctgtccggatcggttgttagatgtagttgatagctgaggacacggcttagggcaagctcaccttcatctgtctctcgagaatgtttggtgggatatctttcaaatgcattcccatgccactgacggcttcgataatgtcgagggccatgaagacatatgaattgacctatacatctgcattagtatctggtatttcttcgatatcgatcacccaacttaccagtgcaataatgaccatccagtcatttgcttccacccgattcataagtttcatacgagtatacatcctcatcgcaacgaaacaggttgccaaggctgtgaacacaacgcttatgatcaagccctcctggcctccggaggacaacaatatgccgtcattatctcgcctgaagatcgcatctcgaatgtacaacaaattcattgtcaatcgatcttgcggctttaaacaaaagaagggatggctactcctcaaagagaagattgcctggggataatccaatgatcagatcagtataggatgttgatctgattcacgattgagatagggcaccaaaggagtgataagagaacaacctctccagtaagcgaaaattacgagaggatatcgcagtattataatcgcaagtgcataaaactgatgcgcagcgtcgccatcaacaatgcagccccagaaaccaaacggcctaggaacgaatccactatccctttttcagagagagacagtaccaattccctaaaaggacagtcatttcctctcccctcactcctcggatgagcgggcgagtgcttctgacgcgagacaggatccccgtctgggaagcgtgtttgcagcagcgtgcagcgcaaggggccccatacaacgaatcgggtccagagttggccccgatggactcgatatgtacatatgtgctccgtactaacaattctacgatgtttctttgttgttttttttgcttttgccctcatttttaaaaaggttttctctttgaacctggttgtggctgcaatttacaggacaaattatagtttgcagggtccttggtatatcaatttccaccttatttcgagaccccagaaacatttaccccttcgtcccactggtcttgatcaataatttgaatctattcatgtcgatcgcctgtggacgatctgctcgattaccgatcagatcgggtctccactgggttattctctcgattgacgcacggtaaactatacttccacggattatcattcgatttcaatattttatgatgctatactccatatacatgcaatacaacttagttgaagtgattccaaattactttgaatatgccatgacgcaagtcttgcatacagtttgtacctgcagacagctcggaggtcatcttattcgctatccgatcatctccgacggtgacactgaacaacaaaatttatagaaattgatgatgacgcgtgtggcctgatactatactgacttggagttagccaaccatatgtatcaatctgctcatggaatctctcactgcagttggtctatatgtggaaagatgctcagccatagggatcaattccggcttaaatgtgtcggccttattaattacagggcttttatgatggtggtcatgcgactcagcttagttagaagtcaacctctcataccctattctatacggattagtccaggtgcggtaaagactgccaggcaataaaggcgcagtgcaaacagtaatgacgggggcggaggggagtggttggtaaaagcctggagccgcaatatcgagacagccttggttgatcaggacacgacccttggctgaatacactaccctatacatgagttgatcgactttccttcgacttacggctctcccctcattttgttaccttggagatttgaggaatggttattacaagattgcgtctgtcttaaacagtcttaaacagttgactgagagacgaacaatttcctgtagacattgtctcattttgcatgttagggctctattaagctcatctgccgcatctgatgtgtaaggggttctctacttattgccactgaactactttctatgcaacatatatacccacatctaaaataacacagtgtccaattgaacatcaaaggaaaatatgggagagagactaaatctcctatttgttggaacacccagccacttccctcgataatgttagaggcctcgtcagggataaccattttgtattgccccggatatccgttcccgaaaagcttcgtttgctttaatttgagaacttgtttaatctattaaacctgttgaacttttatgagtgtctctcatacaaagaacgtcagtctcagtatgacaaccttggaatgtggcctcgattagtcgcgtctcacaacatccaaagctgctaaccacgtaactcagctcgtggcaatgcgtcgaaatttttggaagagttcaagaaaaagcaattaaaacgttacgctatttgaactgttccttaatggagtgtggccgaaatggacccctgccaagtggcgttggctagttgacatatcacatacgatccttagggctattcgtctggacacaaacgtattgaaagttggtcctctatcgcaggatcaaagaaacatggctttgcgtttctaactaccacattttcaattctgtagtggaacactcatatatgcaatacatcttgtcaatatgcagggcgctaggtgctagactcgcgctgtatgcaggctgccttgcttaccgagttgtcatggcagcttgggacttcgaatcctgccttaacctagaatgtacggagtagaatctactccgtagtctctattaggatcagactactcctcaatgcttaggtgcttactccgtacatcaactacttttgattggagaccgaaaacttacactcgatgcttaaattgttagtgatcagccagggaggaactaatgggagttaaaaagacggttagttgcaattttgggcaattgataagccaagacggttctatacctactctagtcaacgatgccatgggtaggatgcatctccttaccatccctttatctccggtcacccaacttactgcagctagccggattcaaattgggatcgggacagcttgattggagtggattccacgtgtattgactactttctctctctttctatcgtggctttgagtctacaagtctcccatctgatactttttctcgcgaagctttttaggaatgtactagctccatgtttagacaacttcttacctactaggcgaaagatcctctgaaattactgggctgtgcaagctacttggaccaagatgcgaactccgtgttctaaatcaagctgctgctggttagaacgcgagaagtcatcatggttccttgcctaggtacagcctgcagcaagcaactctctttgccattgtcttttattttttattttttatttttttacacaaggaccttgaggattttggttgaggctgcaggttgaaacatgcaatgtccctatcctaggaagatcaattatccacagagagatacatatgacacgcgagatttgtggtactaatcttagaacttacattggttggaagctgcttgcgttgaacataggttctctactgagattatatcttctatcaaagtaatcgccgcaagagacgaacagatttgtttggccttcgaaagtatttgaagagactttttactcagcctggggaggcatcggtaacctattggcctggtttccaatatgagctggtctgaacatggcggtgactgggtgttatgtcctgcctgaaaaaaagaaggaatcttattctgctgaggcctagaaggatctgttactaactagagatttgcttccactatgggcataaaatccccattcaatcgaaattgtataggggcatttcagtgttgtggaaaatatcctgacaacaacggtgtcttggcctacattttgcccaaaagtgttgaatttaatatacagccctcaatgcgacaaatccaaatatcaaatgacaagaaaatagacgtacaaacaaagctttctgatgtccaactgcatgtacaaagacacaagtggtgtacctgggcagtagatttggataggcgataagatagaccgataaggacgcacaggccactattcacagagaaatttccttttcacaactcggccaattctttaaagtcgacaacgacctcatcttttctcattgtcgatcagtggaaatagtcctagtatataggacaagatggcagacactactgccccatccaccaagcccgtgtccacaattgtgctggacgctggcccgattctcaagaataccccgccgctttcaaccctccttgctcagtgcgacgaaattatcaccaccccctccgtggtgggtgagatccgtgatcccgatgcccgcgcgcgtgtcgagaccctatacctacctttcttgaagcagcgatcccccacacctaagagcttcaatatcgtcagcgaattcgctcgcaagaccggtgaccgttctgtcctgagtaggaccgatattgaggtccttgcccttgcatatgaaatcgagtgcgaaaagaacgatggagactggcggttaagaagcgtccctggacagaagcagatcaatggaaagccccctgtgaaggaggaatccgaagaagtcaagcccgaggatgcggaggtggcagccattacggagggagtgaaggagaccacagtcgcagacgcccaccaacatactccaaaggaggaagaccccacaacgaacgaggctgatgaagtcgccgaggttgttgttgcggttgccgaagaagaagagaaggacgaagagcaggatgtggaggatgatgctgccggtgattctgacgacggagaatggatcacaccatctaactataaaaagcgtcttgctaaggatgagtccgggacagcgactcttaccgctgcgcccaagacaatgcaggttgcgactatgaccactgatttcgcggtaagtacacccacacaacatctgtctatcgcccaattacttatcctgtatagtgtcaaaacgttctcctacaaatgaacctgaaccttctgtctaccaccaccctccagaagatccagcatcttagaaccttcatcaagcgctgccacgcctgcttcttgaccacaaaggagatgagcaagcagttctgccctcgctgcggcaaggataccctcacccgtgtctcatgcacgaccactgccaacggcgcattcacaatgcacctgaagaagaacatgcagtggaacaagcgcggcaacgtatacagcgttcccaagcccatcgcaggcagcgcgaacggcaagtggaagggcggcggtggccagcgcggatggggtaccgaactcgttcttgccgaagaccagaaggagtatgtccgcgccaaccaggaagaagagcgacgacagcgtcgcgagcgtgatctcatggacgaagactacctgcctggtatcttgactggcgagcgcaacaggactggtggccgtaccaaggtcggtgctggccgcaacgtcaactcgaggaagcgctaaatgtgctgcgtggatgactttgcatcttggttacatgggttggagttttggggcatggaaagaaaaaagttcatctggtcaataccactgtcatggtggttgacggcctttttatgaggaatgaccatgtctttgcttgtgatttacggttgaacatacaatatagccaatccatagggctctttatgaacattttaacaaaatcctcgttgagtacctagatcaggtatcatattctctagaatgtctaggtgaagccctgaatagattatccaaggatagcaaaacaagtatggacatctcagccatccgttgaccgcaagaaaaacaccattcgccaaaacatgggctatgccacccggtaattcatttttcccagtgttgttccatttaagccttagcagaggcctctgaaagacgcaaagttagcttcatgtacttctgagagagcggagttctggaaggagagatgcgacgtactggattgctgggtgaggagaagaccgtaacgcttcttcagagtgacacggtgactgggaaagaggtcagtttccaatgcttcattatgcgccatgtacaataacaccgctactcaccgagagtacttgtcatcgggggagaagcgagcggggtgggcagacttggtgacttcgccgttcaggacctataattgccaaagattagtataatcgtccaaagttgaaactgtgatctgaggagccacatgttcgctgaaaagcggcaggctccccggcgtaaagttttccgtaccttcttcaaggtgtagacacgcttgccttcgttgtcgagggtgtactgttcgtcaaaaaattagcgactgatctccgagcggagctgaagattcgctcgcttcgatgtcgcaacgaaacataccataagatgcattctggaaatagcaagattagcatatgagcaatgaatatgactttcaatacgaattagaaactcacttggcgatatttgataaattgtcctgtgttagtacttgcgtcggcgataagtggaggaatttttttctgaacgaggaagagctcggaccaggttgcttagtcacggcgtgctttttaaacggagctttcgaccacaaaatttcctttttctctcgcacttgagcagagaagagaataatatctcttaaatgacttttgagctctgttaatgtgcagagccatgaagtatcattcactaattgacacttgattcaggttgttcatacatacagagacttttaggtaagatgctcctcagctcttttacactctccagcccatccttcaccttcggtgatgacaccatttatttagctcaggcaggcgacactttgatttctagttgcctgtcaatgattgctgaattgactacaacggtatctgagaagatattaccatgacgattgattcgctcgcatgttatagcacaagtcgctaacctcgaattttgtgtttaggactttgaatattttcttatccagtagcggttcccaggatgaccactccagtaaccaccatggacaaacctgtggctgccaagtcagggcctgcatcagatgcgcgtccgcctcgtgcccctcgacctcctaggccaaactacagacagattcaccagtttcctcttccggtcaatgtacatcacgttcctcctgtaatccctcataaccctctttctcttataagcgttgctctctcgtacctcacattccttatctcgccaccccgtcaagaagtctactcggcctactttgacaaaactacctcatcgatccatgtcacggacgagaggtccattaatgccttatggcagatggggttcttcggcaagggtagtctcagtcgaagtgaacccagctggctggcgcgagagaaaaaacgaagagggttacataatgggaagaccagcgaggagatgacaagactgcggcggactgaacgtcgtgaactgaagctagagcgtgcccgcatggagaagctggccattgaggaaagactcaaagccgaggcggctgctagggaagctggcgtttctgagcctcttgaccaagctgcacaatcaacacccacagacgatacgactaacgtcacagcggctacaacggagaagttctccttgaagaaagcaaaagaagctcggatgctggaggaaaagaaggcacgggagttggctgcacaaaatgcggctcttgctgaacaaaaccaacccgagacctcgtctaacaacaaatccgtgcgcttttcacccattgtgcaaaagaaagaatttctatccacctcgccctcatcattacaattgcctgattcagtcgtcgacaacctcgattcagatgacttcccaaatgaagagcatcttcaactctccaacgaagaggcattcttccttgcctactcgcttggtgcattgcaaatctacgattcgccctcgaaattgggtgaggtccaatcaacctcgtcaatcaccacctctgcccttctccaacagttctgccaccactccttccaacctgcccgtgacgcctccgcgtccctcctaccagatgatcccttcatgatctcctacaccgtctaccatcacttccggtctctcgggtgggttatccgctccggagtcaagttcggaacagattacctgctctacaaccgcggaccggtcttctcccacgccgaattcgcagttgtcatcattccttcctacacccacccttactggtccgaaacagaagaacggaagaactacacaggagagaagcaggcgaggagttggtggtggatgcacagtgtcagccgtgtgcaggctcaggtgttgaagagcttggtcgtctgctatgtggatgtgcctccaccagctgcttcgctcgatgatattggggcgctgtttggtcaatacaaggtgcgcgagttcctcatcaagagatggattccgaaccgcactcgtgattgattgcctcgctttcttttggatcccctcaaggcggggaatattaagggcttctgataccctctctgtaattatgttgctcgcagtactgtacaaatgcattaccgttgcataatgacccatgaaatccatgtcttatttcttacttggttccaatcgaagtagtaaactacctaactatgtactttgtatatgtgtgcataatcaaatgtccaaccttggaacgctgttgagagtgccttcatggcgctagtccgtaaagggtaatattacttcgaggcacgtgacacgcgtttcgcgttttaacgcctccatctacatttacgtctcgatgcaaggcatttgaagtgtcggactgtgttggggcgaactctacaaaggctgctgttgctatcaagacgtgctaggcttcagggactttatgtcgtcgaaaaatggagacccaggacgatagcatcgaccttgcaaagttgcaacgcgacgcgttggggctagtatgtaatgaccctgcagcgtccctcgccctcattggactaactccgacatccccaggagcacgatccatctcagccgtacttttcgagatctgcaaaaacaggtaacaagccgaatcacacactttgttacacataccacacagtcaacggcgcttccaatggtgacggggtgtgcaccggccaacacctacctccgaaaacaccatcgaaccccacgagccttgtgcaccaacaccaactacctcggtctcgacctcggcagcatgaacgacgcccaataatgtctgataagcgtgacaatgaactgggtattgtaccgggttcgcaattcggcaacatgagctccgcagaggctgctcctggggacactcaagtcgtctcgcagtcagtgtacgacagcattatcagacagaatggggagtccatgcagcaggattattcacaaacaggggccgacggagcgacattgagaacattgcatgagggtgacagcggccatatcgacctcctctccgaattggacgccacgcaccatggagcgaacctatcccaaggcgaagatgataacgacgacgagagcaccttcgatcaaaacgagtcttccccgatggcctacgcaccggatctcttccccgaatcgcaacgcttcctagcagaaacacccggaaccgtgatgaaaaagaatgaggcaaaaggtgggacaacagagaccccgagcatctcgcggaatcccctggctagtggcatcgagtcaagtggcggtcttctcggtctgagccaggttttcggggctacccaggtcccatcctctcccattgtccacggcctgcaggcggaacttgtatcggatcgtccgtcgcccaatatcccgattcaacccgctcgtgttgtcaatggtatttcgtcgccgttgatgggcatgccggtccagtttatgagagaatcatcggaacccaacatgaactatatatcgatgaaggaatcgcagacaaagcgcgacaggactttgggggagaggttgacacggtcggccggcaatatccagtcggaccagagtgacaaggaattctataaagagtcgagctttgtagaacgtgcacggcgacagcgacagatcgatgaggaagctgcggctcagttcgccggactgagtgctcctgccagatctacatccaatctctccgccagactacggacttctcccaagcagccaggtagacggcaagaccaggaaatgatagaagctgttgccagcgaggaagaaaccgaacaagaagaagatatgcaagtgccccggtcacaagagcttcctcaatcttcagtcgaagaagacaaagagaactacgacggacctcctctggatgccgccgccgccagtgcccacgaccgactatctcaggtacttgggtttgagccgattccctccccttcccggatgggagtagacgaggaaatggagaatggaatgggtcacggaggctcctttggctcccacagtggtggacagccgaacggtgctatgcgttcttcccaggccatggtgaaagactctcaaccatcacctcaatcatcaccaaaatgcacagaaaccgacaatactagggaaattgctcatcgctcgccttcgtgttctcatgtggattctcccgcacgagaccgtcttcagatctcctctccctgctcgcgaccacagtcaagacattcgaacagcaatacccagagaaatggctccgtgtcagatgaaccttcccttcaacccgttcagggtgcgtcccttaacgagaatatgcctacacactctagcaatccctcggagcagcaagttgtaaactcatctcattccaaagttggagcgggaactgcggcaaactcatcatcgatgccatcccgtgtggctgagacacctatgaatcaacgtctcaagcatctcagtgatatggctcgattaacgagtatcccagaaacaagtcccagtcactcccagtgtaattccgaggttgggtccaatggcgatgggctgaacaacgaagacgacgatcttccacccatgttcagtgaaatccccagtgttcgaaagaatcatgtccgcccagctgggacaagggcactctcttcgcctctcaagaaactgctgtccagtccaggaggaggccaacgcagggctttgactgaaattgcagcagatctctcgccacaggttggggcaggagggtttgatatgggaattgggatctttaccactgaggatcaagagttcagagccttgatcgatggatcgccgacccaaccgaagaagaagcggcgtggcaataatggctcaagttacattgcctctgaccctatcatacctctaacccctcgcgcacagcccccaaaatccgttgcacccattcgagcaacacaagaaggaccagctcctattcctgcggattcggatgatgtgcctttggtgcaactccccgaaaaagccgtgcgaagacaatcaaagcccccgcgacgagccccggagaatgtttgggaaatcgagggatcgcctgagcagcccgtccgccggaaatcaagaattagcaagacctctacatcgatgtctacccaagagaatcatgtcccaataaagagctccggacttactgggagatcagccccccaaccaaaggttgtagtttataaacagccaccacctccatcatcggaactcacggaggtctcatcaacaattgcttcggaagatataattgagtcagaggcgaacagtgttgatgactcccctaccacgcctcgcccatcccacacttcattggaaaataccgtggttgccccaagtcaggtcctttctgtctggatgggccagaaacgagcatactacccagcaacatgcttcgggacaccactgggtgtatcacaagttaaatactctgtgaaatttgaggacagtcttcctgtcgaggtgcccaagggtgccgttaagagatttgagcttcgtgtcggagacggtgtcaagattgagatggataatgttccaaaagtcactcatatcgtccgcgggttcggtgacaagctcactagagaacagctggctaaagccgcggacgatggcctttatcctataaccgacatttacggtcacaccactgtgatagtcggtcccaagcaacgcaaaagcctaccaaatggtgggattggcaacagcgagaacgtgatcaaagtgcctattgctcgtgtctatcttgatacgatcctgtggaatcaactcaaagaccggatgttcacatatcgcccggcgcctgttcaacaagagagcacggtgcacaccccatccgaaatgtcatccgcgcctgcttctcccagctctcgcttgtcccgcagcattcaccaaggcagcggcatcttcgctgggatggtatttgctgtctcttacaaggaggacgaagcatctaagaatcgtgtgactaggctgattatggagaatgggggcactgtattacatgatggatttactgaattgttcgaggcttcgtcaattgttcccgttgatactcccacaaaaggtggggccaagaatgcagacctcaataacaaggggctccgtcttacagctcttgctgaagacgttggctttgcctgcttaattgccgatacccattctcggcgagaaaaatacatgcaagcactggcattgaacctcccatgtctggccgggcggtgggtagaggactgcatcacgcagggtcgcgtcctcgactgggatatctacctcctcccagccggcgactcaatgtacctcaatggagcgacaaaatccagagtcatggctcccaaccctccatccacagcccgtctctccgaaactatctccgcacggacgaagttgctagcagggcaatcagtgctcctcgtcatgggccgtggaaaggcagaggaaaagaggaaagcctatatcttcctgacttacgccctaggggcttcccgggttgagcgtgtccctgatctcggcacggccagggccttgatagactcgcagtccgatgccggtttgtcgactagctgggactggatttatgttgatgatgcagatcaagctgctgcaaagtcgatgttgatgcctaaaccgaagacgcagagaattcacttgttccatgggaagaagcgtaggaagtcgattgcatcgtccactcctacgccacctaatgagctgaaatgtactgcgagggttgttggtaatgagtttgtttgtcagagtttgattttagggcgcttgtttgaggagtgatttcttgtgctcgttcttgataccaatgtcatctatcatatttattctttaatgaatctattcggacttccatttcctatgagattactactcgctctagttagatgttaggtagattaacgactcaccaccgaagataattggggtgtaatgtctctaaatagaatattgcctttggattcattgtgacctcgtatctgaaggagtgttcaccacgttatacatggattctacatccacccttatgtcctaaagtcatgttgatgtcggatctcatgcaattcaatgaaatattagaaccgtacggactgtttgcccctttcttgaatgattctttgtctggcttccacttaagatctagcatatatctacttgttctactatgtagatcaatagtttcccttcttcatatcgctaccccatggtattatattcccgcagaagtttactccagccaacctctctatacatcaggcttaccttgcatacttccttaacaatttcctctccgtccctttcaccgggattcaagccccaagttacttggctggacttgatgttctaatcagacgatggattgcttcttttgcttgccccccacttgcctctctttcgacttgcagcaaaatacgcaaaacatcatcttctctctctcacgcagcttcttatcggtcacaccgccatcttctactcttgctatcacaactcgttctccgattccatcccgactcatctgactgaccaaggtgcaaatgaaattgtattgttctctgtaagatctcaacacacgatcgctagctacctcagaagtgcaaagtgactgacggcgggaagaaatgccatacagtggagagcctgtgatctccggatacaagccttggaaagacgtgtactaggtatcgcgcaacgacttactcgacttgaagaggcggagatggaagatgacgggctgtggaaaggaattcggagatctccctactaggaactcaactcgcacacttgaggtccggcgcacccatgagctgttcctagggaaagctagcccattctagtaattcccaccttcgcccacgctcgtcttcgatcccggcatccggcaaattgtcaatacattatatatttacatatatattggagggaatcacaaacctaagtctctggtttccttcacagcacgaacgcgttgaagagcgtgatgacgaacagtcaaggaaagcagatcacgaaagacgaattctctagtgacgtttctaccaaggaaagagattatctatgggaatatataacggacgggcagtcagaaaatcaaccctgaacaatgacccgcacgcacagcaacagtgggattcagcgtcaaaagaggagcatcgccttctacgttgcttatgggaccgcaataagatggacgccggcgagatgccgcaaaggttcaaattgggccaatactgcaaataggttcaagatcggctttagaaatcccctccctttcaagcaagtgatagccggaccctcaactgccaagcttccactcctcccaacagagttggatatcgtcttgctccggcccgcagataccaataagcacccaggcatgcgtcgccaattcattcaagacttccgcgtacgacgacagggcgtttcccaatggcttcggtccctccaggagaatacgtatggtatcggggcatcgccgtctcgtgtgatcgggtccaggagctcccggaagatggtagagtactagatcaagtacttacccaggacattagcgtcgtttcccaggagtccgctactaacgatggcggtacggtgtcagatatcgatacgccggtggtctcggccgtgccaaacttcctccctgaccactccgagatcgatagcatccggcggatggcagggccccatctcacctgaaaatgcctccctgccggagcacccctctcgttgacttcaacgtctcagaaccgctattgtccgtagctttccccaccctattcccgcgcggaggcgccgttgtgacgcctcgcccaagacatgtgccatatcgtgactatatccgacatttgataaagcacgagtctggccgatttgcgcggcatccacggttccagttcgtggcgtccaacactccatgggattcttgtgcgtcaacacgcccatccagagcccgatatggcttctgcgctgacgacgaaatcctaccgacgacacgtcatttttcgatcataaataaaacgcacagatggaactggcttggtacacagacaaacacaagctcccctactatgacaaaatcgagttcgacgagcatggatggttgatcaccccgccaggtgactaccgattatcggacgccctggttttcttgatcgttgggcagaacatcgtcgtcgcaagaaaccgccatggtaaatggccgacgggcttcagctcggacggtgacatttaccccgatcgatggctggtgggcgagccagttattgtgtgggcgcatgagctcccattcattccgatattcgccgattattacgccctagtcggcttctcagaagcaaggcgacttgtttctagagtcaacggccttggttccggtatcaagtttaaggccgactacttgtgaggcggaatccctcgggcaaagcacgcgaaaattgtccaaaagcaaaaagaacaatggttgaagttgtaggagcaccacctgataagaaggtgtctctgtgcattgcgtgaacccctggtctgagggccaacagcctcagagcttcttccgatcagatcaaagctgcacaatacacgtcgaagctacacacaatcggcagaactggagctgagcgatcattttgctcgacctcggcgttgaaccgcacacctgagaagcctttcgttgctgatgaggcgaacaaaactcctctgcttggggcatgctcccgttctctgaactgctccttctcattttgaatatctatttattcttacaggaaaccaatatgacaaacactattataacaaagccttgagtaatcagcgattcgtactaggggtagtctctttgctgccagacaggcgctcggtagcgggcataggcccggtgatatttgtctcatgagtggtatcgtaggtgtcttcagttgcgggttctttgcctttaggctccagttgtgcacttggctccacatccgaaacttgatcagcagtagctctaagctcgggcatgtttgacgtatgcgtgtcgtgggtagtttggttggatgctccctccgtatctagctcaatagctggtttacttccagcagctggcgtcggttcctgggcatctcgttcatgaggtacaccgtgaggatctctaatgggtaattctgcagttccaggcgtctgctctgcgcttgactcgacagctgctggctgatcagcagcgggtaccaaagccccccgtggttgcccgtcagggggttgcgtagaagcctcgggattatgttcgcacggctgttcagtgccctcggtggctggtgccgcaggtgcgtcgatacggaagaactccccgttcaaaacctcgatgagggctcccgcctcaggtggtggtggaattgagccgctcagtagctccttcgctcgaatcttccgcccatacagctttttgtttgcatccgcacgctcggcaagtacaccaccctcgactgtaaggccgccgtacaatccccgagtcttggagtaggcgaagactccagtcgcacccttggtaccgactacacccccagcctcagcgctccgaccaataggcccgacagccatggatatattcccaccaagagtcaagtttcccgactgcatgaatgtcttcactgcggcatcagtagtcagaacgaacacgaaatcggttaattctgcaccaaattgaccaccagcgccgaggccgcccattgccatggctgacggggcggaccagctgccatctgggagacgagcgacaatcagtcccgacccaaagcggatagagcccaggaatccgaatctgaacgctgtgaatatggcgatcccctggcataaagtaagtcacgatcgcttaggttatttcctagtagtattatcccttaccttggctcccgcgaatatctttcgtgggatttctccatcgattttgagcttcgggttgatgaaggattcgagaatcgcagcggcctttttgcactcacctgtggaacacggtcagcctggagtcgaccatgtggggtaacagtagcacggggaataatacttgatagcgaggcaggcaacgggttgtgcaacgggttcttcatggaagatatcttttgtcccgctgatgcggtgtgtattaagatgtctacgtctagcagtgtcaggtatggtctcctatatttggagcaggctgagcagactcgaatggaagaaagaaatgatactcagccgcctccgggagcctacgcaaatccaagtgatggttccaaggttgttcttgcaatgtcgtataatcaggggttttggcgcttactttgcgcacggacgtttcacggggttagtatactttgcggttggaacagaaatggacgtgaaggttcatcggattctaaataatcttatgcataagttctattttgaaactctcctatgtctggtgaaatgttagttatgttgcactgtgttgatttagacgaaactgccaagtatttagggcttcggaagatggagtatgcagtgatatatatcatgttacttggccgacgatcaatgacccctagagagtagtaattgctctaaaatgagactcaatgttcgtgcgcagcttgacgaattgattcgcatagctttaaacagaccagtcaccctagtaggtcatctcgggatggtttatgcaaggtacagattaacattgcgggtcgaaagcaggtacagagtacttcatagctgggacgaaaatataaacattctcggagggattattcattctctataattaagatacggactacacatgtaatgtaacgttgaggttgagaatcagaagtacccaggtaaagttcgtctatcacatccatggatagggctggcgggccgcggttatgcttaattttgagccaccaggtgggtgcacttatctaggtagtcgggtacccggataacggagattgctgtgcattgggataattcaatacaatgaaaccagaatttactgcatgcctcaagaccgcaagctcttcggaaatgagcctacttcagtgcaacagttgcaatgttccggtcgagaattgtacatatcggttctgtttcgctgtaatacggccgcatcttgcctcaagtttccagcggttgcaccattatcacctatgctgttccagaccactctggtcctcctcgtactccaggcgagtaccgtggcatccgtgcctgcggaacgacgcgcaattcccatcgcggaccaaacctttgactatgtagtcgttggtggcggtaccgccggaagcgtgatcgcgacgcgactagcacagaatgacttcgacgttgcgctgattgaagcagggggatactatgagcttgggtctgtggctgagtttcctgcagctgctgcattgacgatgggatcagatcctgctttcagctcaccggtggattggggctttgtgacaagagatcaaccgggtgctaataggcgggcaattcatgtcacccggggaaaatgtctcggggggtcgtaggtgtttttccaaacctgacatatcagatcgaagctgacttcactccaggtcggcgttgaatttcatggtctaccaacggtaaaggaccaaggactctgaatactcagcttaactaactaggatcatccagtccgacacgtgagtctatggagctatgggcagctacagtcaatgacagcagttacacattcgatgaagtgctcccattctaccagaagagcgtccagttcacgcccccgaacactgactacagagctccaaatgcctccgcggactatgatatcaatgcatacgattcggatggtggcccattacaggtgtcgtatgctaacttcgctcaacctttctcgtcatggatgagcctcggtatggaggctatcggcattgatcaagtagatgactttaacctgggcaatataatggggactcagtattgtgcatcgaccatcaacgcatccacccagctcagaagcagctccgagtcatctttcctaaacaagatcacgcccgactcactgacaacctatacaaatacccttgccaagaaggttgtctttgatcaaaacaaaagagcaacaggagtacaagtgaaaggcttgctgggcaataccatcactctttcagcatcagaagaggttatcctctcggccggtgcctttcagtccccgcaactcctcatggtgtctggcattggaccgcccgaccaattacaagagcatggaatcaacatcatagccaatcgaccaggggtcggtcagaacatgtgggatcacccgttctttgctccttcgtaccgtgtgcgggtgacaacattcactaaatttgctacgaatctgctatacgcggctggccaaattgtcgatgcgctagtcgccaaaaatggattcgtcaccaatccaatcgcggacttcgtggccttcgagaagattccgctcttcttccgctcggctttctctgagcgaacgcaccgtaaattagccggatttccatccgactggcctgaagcagaggtgagagaaatattccctcacatagagagaaaggtgtataacacgtgaggttatagtacatatccggcgcagggtatatcggcaatgtgtcaaatctcctggcaaaccagccaagggatggataccagtatgcctcgatactcggtattctgattacacctatgtcccgaggaaatgtcactttgaagtccgcagatacctcagatctgccaatgatcaatcccaattggctcgatgacaaggctgatcaggaagttgtcattgccatgttcaggcgaatacgccaggctttccagagtgaagctatgaggcccgtggtcatcggcgaggagtataaccccgggccacaggtccagtccgatgaacagatcctcgagtttatcaaggataatgtgatgaccatttggcacccgagttgtacttgcaagatgggaacttcccgtgatgatatggctgtggttgactctcaggcccgggtttatggagtgaatggactgcgagtagttgatgctagcgcatttcctttccttcctcctggtcatccccagtcgacggtttgtatgtttctctcggttactgctctggtttaccaagtgctaactgcatcatagatatgcttgccgagaagatcgcggcggatattatccgggattcccaagtgccttaatttcgattcagaggcgagtggagaaggatccaatggctttagatacatgtttctaaattgacatttagataataaattaccttgtcgattggctttgctgggctgtgctaatgccaactatgggaggcacactttatacatcagcatgccatggaatgggcttgaaaatggcgattgcacgccaatatatccgtaaagaaagaaggggaaaggtaataaacgtgggaaagttgatgggtaaatgctctttctataatacagtgaacaccagatacaaatcctcatatcgctacagaaacccagaagttattggaacaagacatcatacacacggcaaatgtcctcatttcttggccgtcttcttcttgcccttcaaactcttcagctgagcagcccgctcggctctctgctggcgcttcctccacgccaaccaacggttaccacggtcatgtggcatagcagtgataccagccctctcggcagcccgaccaatctcccagttagcctcacggtacatgtagccagggcgcagctgggggccagacgcagcctcgacagcctcgacatccgccacacgaacaccgttctcatcaacagaagcaacgagatcagactgagcctcgacgcgttcggccatcggcacaggggccatgttcagcttacgccggctgggcgcattgcgagggtgcggaagctgctcatccttgtcgaaaacaactccgatataccggcgcttcgagtgcttcagcgggtcgaggtagtagcgcacgtagccagcctgtgttgcatagattgtgtggtcccgtcccatcccgcagttctcaccggggaaccatagcgagcctctctgccggaaaatgatgcatcccggtaccacgtactcgccgcccgtgcgcttcgctccgagacgcttaccggccggatcacgtgagtgtcgattggccgttccttgcgaggcgtgtgaggcgtgacgcacttgtgtgaatgggagaagtgcgctggagagggagggtgttggtgtggttttcgggaatgtgggtgttgcggagagggtgcgcaggagggattgcgattgcgagagcgcgggtgtcgaccggattgtcggggtaaaggctcgctccagcgcccgcaggggcgttagcactcggggcttgaacatggtaggttgtaattggagtgtttggaggtgtagatcgtgaagctccaaaggggaagtttttcgttcggagatcgggcttggcgtcacgtgtgtacccgtaagctggcttcatctatacaccaactcgaactcgttctactttctatacaaatacttgattctgcaaatatcgtgtgattattcaaattatgttgcaaagctggcgccaagccctctgggctcttctccttctcgtgtctgtcgcccaggcccaattcaacttcttcgaccagatgttcggaggcggcgagcaacaacgccaacagcagcggtcgcagaacagtcccagtgacagtgaccggtaccaacagatgtggaatggaggtaagacccaaaataactgtctactgagaacatgctgtcgcaagtccacatcgccctcgggtccacataactgactatcatgatctctttatagcacaatgcgaccactacctctgccctggaactcttgcttgtgtacacttcccacaccactgtccatgcccccaccctgatgtcgaggagaaggtcgaacttggagaaggaagtgctgtttgtgtttcgaagggaggcttcaaggcaggcgaagctgcgcggaaaattgaattggctcgcaagggtcttttgtgaagactttgggcatatgctctttgctttatataagaaacgcatacagctcccgtgggttgtgatcaagtcatggagcttggtgccgctggacggattaatccgataaaattactatgaatcttttttggacatactcagatgtgcttcaaacttggcaagcttacttcgtatatggaaacggacgcctgtaagctcgtatcgaatctagtgactctatctaagacatgccaatgtgctcattggtctactatgtatacgtattcgaggcgacttgagatgcgatttctcatgcctggaaaagcacccatcagtgatcctcataaataattgaataactaatattggattgacctggaaataatctggatgtcacagaaatataaccccatgcctcaagtaagagtacacgatctacaaagcaattgtcgtcgctatctccgattatctccgcagtggccttccgtcatcggttcctcagcctctcggcggtggagtccacgggttacttaccaacttcgcatcctatcagtcttttgcctcaacccttacgtttaagctaatctggtccctctcaactaccatgtggggtctaaggctccgactcctgcaaaagcagtggacaccagcgcgaactcgagctctttcaagcttcagaagtcatgaattgcggcgtggtcctcgtaatagcataaaaagaccaaatcccatacagtcttcgaagaaagtcgaaacctcggctcaacctgaacctgctgcctccgagtcccaagataccacaagtcccaattatgacccttcgcaaaacactctgctttctcccgtttacgtgcctgaagatcccagaggtgtgcttaaagaaaaccacccggcaatttcaatactggcgaactcaggtatagtcgtacagcgagaactagagatgatgaatgttatgatgtgagtgctgcgcaagcccatttaagagaaacatgcgtactgactccctcagtggatttgaacaagcgaataagtatgtcatcatggatgcgcagggaaatcacattggatatatggcagaacaggacaagggattggcaaatacaatggcacggcaatggttccacacccatcgaagtttcgtgacacatgtatttgaccgacaggaaaatgaggttcttagagtaagcgcatgaaatagccatctttgctgtgattttggcttggctgaccatcacagttcaatcgcccgttctcttggatcaactcccaaattcacgtctatgatcctctcgatcaaacgccaaatgcttcctcggcatccacctctattcaaagctcaacatctggttctctcattgaacctggcacgagttctagcgcaagaatatcccctcttggtctcggtcagatgcgagttatcggcgaagcccagcagcagtgggcgcctttgcggcgaaagtacaatctcttcacgcatcaccagtcccccaaccccgaaacagacatgggaacccgtggtttctcgctatctgactctggtttatcacaagcacagcagatgcaactggcgcggacgcccgaccaaaatgagggtatattcaaccaatttgcctacgttgatgagccgtttctatcatgggatttctccctgaaatcagcagacgatcagttgattggatccgtcaatcgcgatttcgcaggctttgcgcgcgagatcttcacagacaccggtgtctatgcaatgcgaatggattctgcagctctcggcacaaagacatcaaccaacagaaatctaggcatgaccctcgaccaacgtgctgttatgttggctacagctgtaagtattgatttcgattacttcagccgtcaacgaggtggccttggtatatttccgcccgggttccctatgggcggccaggctcccgctggcggtgcagctgcagaaggcgctaccgccggtgaagccggggctgttggtggagccgctgctgggacacttgagcgagttgggaccgccggtggtgcgccaaatggtatggtctccggtgctaccaccgcaggtgcaatggctgggtatgaagcaatgcagaggggggccagcacaaccgaccccaacgcaccaccatcggagccagtagacccgggatcacaaggcttccaggatcaacctcaagacccttggggtgcagacgatccttggggtgacggaggtgacattggtgatgggggtgacggtgattattttgactggtgatgagggtcagtttctgtactataaattaacgatttagatgtaatatttgctcttaaaccaagaatattgtcattcactttggccttgtcttccctaaatacatgttccccaacggtatcgccacgcctcgtccaccgccccggaattattccatccccaccatttatcccacccaagcccccgcagacaaccctgccacctaagtatttccagaacgcatttcgcttttgaatcaattaaacagcgaaaatggcgtccaccgtcgctcagaagcgccttttccacgaatacaagaacctctccaccaacccaccagagggtatcaccgcagggcccgtctccgaagatgacatgttttattgggaagccctgatccaaggcccggaagaaacccccttcgagggcggcgtcttcgcagcggaactaaagttcccaagggactaccccttgagcccgccgacgatgaagtttatcggaggtggcgtatggcacccgaacggtacgtgacagagacagagacttgcgactggccacttgctcgcattactcaacgcacaatggcaaacacattacttatgcaatcggaatacagtataccccaacggaaccgtctgcatttccatccttcatccccccggcgacgacccaaaccactacgaacacgcctcggagcgctggtctcccatccagagcgtggagaagatcctcatctctgtcatgagcatgcttgccgagccgaatgacgagagccccgccaatgtcgaggctgctaagatgtggcgcgagcggagagccgagtacgagcagaaggttagggacgaggtgaagaagggcctggggctgtgagtcgggttggactgtggttgaatgcctcggttatctcgctgctgcacatacggatgtctgtcaatatggtctgcttgtgctgcgcgggagtcaaggtttgatgactggcgttcgagggtttcttttttctctttgcatggtttggatatgagatggcttctcggtctgtgcttctcggtctgtacagtgcattcttatcctcgcattatgatagcgcattaaatacatgcagaatttcgatacactgttctgttctctttttccgacttgctaaatttgcatctgatttagtactctcttcaaatgttgtctcgtttacctactggagtattggagatccttggcaagtattatggaatatcgctcctgtctttattttatgtggtctatgcatctatgccttcctagatatacatatcctacagcattttactcctgccgaaacatcctccgattaatccacccttccaaacccccttgacatccatacaagatctcaatctccgccttcagattcaaaaccagcattcgctgcaattcagcacgccattctggctccggtccatcgctcgcccagacaggactgttccgaagcatagccataattttcttgcggtctcgcattgtcaacgaaagaagagccgtgtcaccgagtacctccggcactgctatgatatccgacacgcgaagaccaagccattgcagcctcggtatactgagacgagcattttggtgcaagttggccgccgagccgtacttgtacgtcgacatgatggccataccatggggatcaccatcggtgagcgcatagaaacggggcggacgtctgctctgcttggacgcggagtcggacattgcacgcaggaacgttcgtgtcatgaaatcggggtatcctttaccctgttggagtaacgttgagtccagttactcgtctgcgggacagcatatgctaaatcagagacgcagcttaccgtgaccataattccttccccggctagtgctctggtgtggtaacttattcgcgcgagccggtggaagactgcctgtggacaggggctcagcgtactgtcgctgcacatgctgtctttccatactccgtacctctttttcaatgaccagtacccagcggacccgtgaaatgtcgatctcgtctccgtcctctatgcgaggaatcaaactgtcctcggtggcagactgcgcatcgatcaaaatgtgggagccacggatcagccgaaagtctccggtcaccagcccttttgctgctgcttcctagaaagtcgtgcacgatgtcagcagcccgtctttgcagtgctgtggtaccagagcattcggcaggacaaaccacattcaatgctgtcctattcactccgatggtgtacgccaggtcatcaacgatgccgtccacgatatactgcatgcggaagaattccgggtcgatatagtatatgtctctggtgattgtattgatgtgttcagtacaccttccagacgggttcgtggacattgctagctcacctcttggagatcagctggcccgttcgaataacttggtccaatatagctaggattcggaggatgacagctaccagaacacccagactcggtcagttgttatccaggaaggatgtccagttggtgttcggactgtgggaggaggcaagatcttactaaatttccatgcctcatatgccgttttcccaggccaagagtattttctgtatgtatcaattctcggactcgcttccaaagctccggtggttgggttgacaatgcaagcaattgggctggctctgcgcttgagggtgatggaaatgtttgcctctgccggggagcgtgagagttcattgacgagggctgcgagggtgttgtcgatgaattgttggactgaagggtctggaccaccgtctatttccaaattgtggatggttggctcagccattgccgtggatttgagcaagacgagatggttctggggaggacataccagtggacctgtccgggtgtaattgagcttacatgacacaacggtacagggctacctcctatgtacctacctacatgtacataggtactacctagttagtaggtacataactactattacctccatatgtaaatatcaatacccacagtaggtaacaattggattaatactggtaaaagatagaatcacttgacctttgctaggacttgatctatacagatcaagaattggttactttgccatactatatgtccaagattctcttccttttgtatacacatgaccccggggactcaacctgatctcgcagtcatatcctcggagctttgtacacaaccgtacaacatgacatacaagtcgagctaagctcgatatcagcacattccaacaatatccacacctcaaccaagactggagaattgcctatttaggaaatttggataacttcagcgtgacaagatctctacgcagagatttgagattctgcaccttgggaccaaatacagtaatgagataatgtttgctagcagtcttgccaacagagcttgcttcaaatgttctacaactctctcacctgcatatatcctacaggtattgcttctctgcatcttcaatctctcgatcaattcatcaatctccatcgacctcatcatcctcggcatctccacaatctggggatagcttcatttctgccggagcaagccttttccggggaatcttcatcccatcaagattctcatcccagagttaaagacctccctcattccgacctttcatctcttcatcgtcttcctcatcgtcttcatcgtctttcaattaatttgattaatttgtttgcctggaatcacatgattcattctacaccgcagtcgtgatactgatgactaagcttcccctaagcccgcctccagggcttcaggtggtgtttatcgtcttggttacatacatgtatgtagattggcgagaaagacccaatttctcataccatgtcttctactccacatatcgggccatggagaaccccaactgagggtcacctcaccccagatgccaatggagaccttaaaaccgactatacgcgctggcgattggtcgacgaggaaggccgtcaaacatggcggtatctcgaatctgatgcggaaaacaacgaatggccacaatccgtggctgataaatatcacttgggactgccaacggtattcaacccccacacacttgaccgaaattccaatattgacggcgcatatagggtcttccagagctaccagaggccaagacgccattgaaagctgccgagaatggactttcattcttctcgcatctgcagctggagcccggaaactgggcctgcgagtacggtggccctatgttcttgctgccgggtattttgatcacttactacgtgactaatacccccattcctccggaatatgcaacagagatcaagcgttatctgtttgctcgtcagcactcggaggacggtggttggggtctacacatcgaaggccacagctccgttttcggtacttgtatgaactatgtggcactgcgcttgatcggtgtcagcgaagaggatccgcgcatgatcaaagcccggggccttctgcataagtttggaggcgccatctacggccctcactgggctaagttctggctcagcattcttggggtgatggagtgggagggtgtcaacccagttccccctgagatttggttagtcacgcactgcaacatgtacaacctctcttttactaactgacgacataggcttcttcctgactgggttccctttgctccttggcggtggtggattcatatgcgccaggtgttcctcccaatgtcttggctgtggtctaagcaatggtcccatcctctagacgacttgacaagacagctacgcgaggaattgtacacccagccatacagctctgtcgattttgctgcgcatcgcaattcgatccacgaggcggacaattattaccccaagacatggctgttgaatacagctaatgaactgctggttcgggtctggaacccttatcttcgactccctagtattgtcaagcgagctgaggaatggacctgggaattgattcgcatggaagatgagaacaccaaatatgcggggctgggacctgtcaacaacccaatgaatatggtggcttgctttatccacgacggccctgacagttactctgtccgccaacacagggagcggttgaatgactatatgtgggtaaagggcgagggcatgcttgcgaatggaaccaatggcgtgcaagtgtgggacacggcattcgtcacccaggcgatcgtcgtcgctggtttcgctgacgagcccaaatggcggccgatgttgacaaaagctctcgaattccttgacgatcatcaattacgagagaatgtgccagatcaagagaaatgctaccgccagcaccgtaagggcgcttggccgttcagcactaaggatcaagggtacacagttagcgattgcactgccgagggtctccggtcaacacttcagctacaggaaatgcacggcttccctaagctgatccccgaacaacgcttgaaggatgctgttgactgtcttttgcttatgcaaaacccaagcggcggcttctctgagtacgaaattacccgcgcttcacccaaggtcgagtggctcaatgccgcggaggtcttcggcgggatcatgatcagctacgaccacccagagtgcacgactgcgtctgttacagctttgtcactctttagcagattttaccccaaataccgcgccgacgaaatccgcgccgcgaagcagaaggccgtcggctacatcaagcgcgtacagcgcgcggacggtagctggtacggctcgtggggtatctgcttcacctacgcagcgatgttcgcgctcgaaagtttggccagcgttggcgagacatacgaaacgagcgccgactctcgtcgcggttgtgacttcctgattgagaaacagcaggccgatggtggctggggcgagtcatatcttagtagctcgacccatcagtatgttcagcacgaaaagtctcaggtgtgtcacactgcttggtctcttcttgcgcttatggaggcgggctacccgcacaaagaaccgttggagaggggcattaagctgttgatgtctcgccagcagcggaatggcgagtggctacaggaggccattgagggtgtattcaatcagtcttggtgagaccgtcctgatacttactttttttttatttacttactaaccatctttatagcatgatctcgtaccccaactacaagttctactggccgatccgagccttgggcttgtatagtaagaagttcggaaatgcagagctcgtgtaaactatctgaagggaaaataataacattacactatgtacttaatcaataatcaagggtctattgagcagggtgttcaattaatacagacatccaactaatgcactggagtcatagtttccttcccctcacgttcccctcacaaacacaccacgtgatccaaaaatgagcgatcgacaggagcttgggccaccgaggctcattcaaccctcttctctggattgcacatgctttttttcacttaatcaacttctgttccctcatcgtatcaccatgaatgctgcagctcagggtgacatggcctcggccgaatccaactaccccaacgctatcgaacactacacccgcgccttgagcgagctaccccgcgctccggcctactacatctcacgctcgactgcctattcgcgcctcaagcccgaaaatggcggacccaactaccaggctgcgcttaacgatgccgaaattgcgctccagctcgccaaagagcggggaaaccgcgagctgatcatctccgctcagatgcgccgcgccgtctcgctgtaccagcttgagcggtatggagacgcagaatttgcgtttggaattatcgcggagaaaacaaagagccagaaagcgccagagaataagtcggagcaggtgcaggctgctatgggtggacctggatccgggtggggtggccccaggaacaattacagcgcccaaatgccaatttggaccgccaaacttcaacggaagctggcagagttacctaaggacgatccgaagcgcgctgtgtctattgctgaattcccgtcttccgtacatgttccgacggcagatgaaattaaggctcagttgacgggcctcggcgctagcaacaacgtgggagtggccccagcctcgcagcagactgagcctcagccttcagagggatcgaccctatccccagtggaggctattttagcttctcgacttcaaagctcaaacaccagtgctacgtctacctcgaccactccggacagggttcgccatgaatggtatcagtcacgggattctgtggttgtgactctttacgtcaagggaatctcaaaggacaatgttgcagttgatatgaaagcagaatgggttggtgatattgttcccggccattattggactcataactaattctgcaaaaggtttcgctgcaattccccctcccatctggttctgaatacgactttaccctcgacccgctctatgcatctatcaaccccgccgagtccaaagtctcagtcaagagcaccaagattgaactcactctacgaaagatgacatccggccagaactggagtgctctcgaaggttcactcaccgaccgtccagccgagcaaaaggcgccaactaccgcgggcccttcgtatcccacctcttcacgccacggcaccaaggattgggacaaggtcgcatcctcgctcactgagaagaaatcaaaggacaagtcgggggataatgaaaatgtatcggatgacgaaggtggtgatgctgtcgatgggttcttcaagaagctgtatgccaacgctgacccagagacgcgccgggctatgatcaaaagctacaccgaaagccaggggaccacgctgagcacgaactggtctgaggttgcgaaggggaaggtggaagctcgccctgaatgattttccacttgttattttctctcttctcataagccgcatgtagcgaggtgttaccaggtatcgcaacttttcgttgtgagatttgtctcaatttactgattttactgtcttctcccaaattatcttattgatctgagttccgaaaagcaaagtagttcaatttgtaaactccgacctcttagatatgagatcccccttccaaacaccaatagatattcaatttaggacacaacccagccctagcccaagtctgctaacactccagggccctctatcggccaggctccagaatcggtccattgccagtgaccgcaacaggagatccatatccatcctgccggcgcatagtagccatgggagcaccatccaccaattccaggcgaaacagagcaccttcgtcagtaggccaattcatgaaggattccgaacgatacgtctgctcgacaatccgagcaggttggattctccgcatgatccccctgatcctcggtccactgctgtttccacgcttatacacaatccacacatctaccggcttgttgccgaagtgccttttgtctgcgctgtagcgtgcacataactctcgtgcaacacggccctccctaccctcatctgacgaaatgttagagagcaaaaagccttcctcgttggcgattgctatgacagaggatgtgcccattttatgtgcctcgacaccatcgcaagcggaccatttgtccgattcggttctttcaccgaccactatccgcggttcgttcaaaagcccgggcatcgagttggttgtttgggtaaatagtagatagcttgtcttgatcggatgaggtgcttgtaggtggtctttgctaacgtgctttgtatctcgagttgatctctgaatacttctccccatcctgcgatcgaactggagtatatatacccatttcctgtcttactgataaatccatctaaaagttgggctggaaacaacgctgcaaagagtgaaacccaactcaacagcagctttccatatagatatattgttggctgggaggcttccacggatcttatagaccggatatcgtgaatatgggatcgtcgagagaactgagacgaaaggtcttgggtttacaagtcggcttagtcctgtaagtaagtatgtaagtatactcgaaggcaaaatgataggctgtgggcgcttagggctcggactttgtctgacttctattcgttctccgtgaaactcatattggcgccggcccccctacacctcgctagggcttctgtcttttacccatccctgtcccgcaagccataatctgcactggtatggttttgttagtctgttagatcgagacgcctgcgtctcgatggggatggttggctcagcggtaaagttgcatctcccccaggagctggtataccctcatcaagcgcagaatggcgctacgagtatgggatgacacaaaactatgggatatgtttcaggtctaagggtctggcattttgcccatgtcgttgatggttcatggccgaaacgggccaatggtgtatgtccatcccctgcttcgtggatgtatcttcccgtttcgagaactcaacttgcaaatttatactgaccgccagtttacctctctccattactcaaggcgaatgcgtggttcggttggttcacatttagtgaatatctcagagaactgtaatatggtttcgtcgaggccgatgggccgacgtttactttgatgaagaccgcagtgatgcggtattattgagtgcgattatgattatcagaacttgctggcaccaccgaagcccagttacttctatatccatgtataagtggaggcgtcctgcgcagcatcgtaagtcgatatgattggccctgcagctctttcgctctgtctctgttgaggaggagagatgttttgctacggtggacatccatacgtcggttggatatcatatcaggacctcatggttaatagccaggtcagcaacaacgcattggggaatctaaggagtatcctcccttttctaactaaaagacaagcatgggatgtgttggcagttgtttcaaagcatgtgtctcgcctattttctcctttggttaaggctttgggctgttctctcgggaatggatggcctcgtgctcacttccagcgtttagttcatttagttgtagcttcatgtttgtactataatacgcagtttgtagtttcaacttgctttccgctatagaaggttgttacattgtaggtacaaacgatgtaaggggatgggaatataccatattgttctaagccttactattatttactgccgtagaataggagtattgctaggcacaggtactgttgataaggtagctggcagctgaagttccataatatttatttcagaccattcatgtatgtaccgtaacttacatcttattcttggatatctactcttcctcctcatcaattttgccatcgcgatacaggaagaattgtgtaaagatcgccatatccagcagcagcgtgccagcactaccaaccagccaggacaagttcaccaaaatataccggccatacagcgcagccgcctcaccaggacgacaatgcgcacggtgacggcggtgccccagaacctcttcggaagacccatggcaaataggcgagtatgccagaatagagagcacataagtcaagttcccaatgcaagcaaagaggaagaacagcagggaaacaccatccgttgatttgcggcggtagttcaagagaagctggggcaggcgcgagccaaggtacaaaactgcacagaaatagccaaatacttgacccagaacgtccatggtgagaggttccgagtctggcgatgatgactttgctgccgggctgacgaaccagcccatcacacctgccgcacagactagggcgacagccgtggagttgaacaggatggattggagggcggagatgcggcgacggcgggcgcgttgagcacgcagttccgcggaatcggagctgggttccacgaagggcgtcgcgggtgatagatgggtagcgtctaccgacgagtggaagatatcatggtacgacgctgctgagtgccgtcttccggcggaggctggatgtggcccggcttggggttgctgtccagttacgtttgtagctgggtcttgggtttgggcctggccgttgggctttgggatgagggctgatctctctgttggtgctgcttgatcggcgccgttcagctccgcatcggtagtaccgttggctgcgaaaaggtccggtgtggccgagggggatagctcctccctgaggttgaacccccggtagtaaaagcactggcccagcagaacgatatctgctagagtgtaatacactgcaaggatgatcatggtaggaagaacgccttgtaggacggcacctaatatgttgaacacatcgccagccaaccagatgatgaggaagatgagagagaggccatctgcagagccacgtcggaagttctcgatgatctgaggggagaatacgacgacccagcaggcaatagaaatagatctggattggttagtattggattaagaaaaacaaaacataaacatgcaaagatcatcgggccaagtagatctacatccgctgtcacgcatgcatgcattaaatgaatataacagccaatggaaggccaccaaaaatgaaaagaagacaagtacagcttggtgaacttacccgcagatgccgctaagggcctcaatgttaaaattagccgcctgcgaagggaacatcttgcaggcgaaccgtgcgactcagagccaagtactttcaagtactctcaatagaggtttgggaagcgaaacaatgtaaaaatagaatgccaatataaacagatgtaattgctggaagatccagctctgtgcaagttgacaataagggaaaaaggaaataaggcaattggaggtgcgacgagaattggagccatggatgacgtgtgatcacgtgcactagaagtataagaagttcagcaagtagacggcatttcaggagctaatttctttcaattccttctatttcctgcaatatatgaagttacagctcgaataaaatgacatttacttaatcatgaggtatcaaaattcaaagacctatgggtaatgtcccctcataagctgctccaacttatcctgggcatcacagaagatatttatggccttgggctctgtcagcgaagcttaaaggtcgatcagtgtatgtgcttacctcagtcagcttgatctggctagcaccaccctggtctcgggcaaacgtgatctggtagcttccacgatcgttgatgaaagagacaccccgtgccgggataggaagtgtcggcgcaatatcaaacaatgacttgacatttcctgcgtaaggttgtttcaattgcgtcaacagcccaggtgaaatagtaatgtgatccaccccagcaaggaagaagatctcctcgacagaagtcaagctagcggggaggactatggtgcgcgaactgatggactcgtagtatttctgaatagctgcgcaaagcgggagcaatttcgcattgtccacgtaactaaaggggccggattattaggttaggtcttaaagaagagtttgaaacttaccctggttgcacatgcaccttcagttcgttcacatacggtgcgatataagtacagttgacctcagctgcgagtacagcttgagccatgctgaacagagtcgtcgctagagtacgcacaccagctaattcaagtgtttgacaggccatcattccttcccatgtacttggaatcttgatacaaatgcgagacacgtcgaaatcgggctggtaatgctggaacaattgcacgattcctatgattgatatcatcagcatcagatctaaccgagaaagaacgctgtcagtggaaggagtccagcatacggagtgcattgacgataatcttctccgtcgagtacgaatagtaaggattgacctgtacatggacacgtccacgaatgtgtcttgccatttctaaggccaacttaaccatctaataatccatttagtcgacttcttcatcaagtccaccaatgctataatcgaaacacaactcaccgaaatctcgacagccagttcgttcatatccatggagtacttcgcatgcagcactgccgcatctgaccgcgctgagacaatgattgcagatcgctccggcttagaaagctcgccgagtgcaatggcctggacggtcaatttcatggcctaattaagtccacgggtagcacgtccatgtgcttacctggttagaagtgcagtcctggaatgggcccagggttttggcgactagaaagcagtcagcgatctgggaatggtaatataatatctctacgatacacccctggagaaaggccagttgactcaccttcatcatccatggtatcacaatcgaccagcgtgcgcgaacgcatataatcgaggcctgtctgtacagccatcttgagtgtagagtaaatccgagatgatggagagacgaggaaaaagaaaatggaaatggtcatcccacttctccaactccagtatttaatagggtgggggggggggggggtttccgggcctccacactccgcagtcacggatttgtcgggccgagtaacatctttctgattagtatggacttcgcatcaggccctgcactgcatgtgtattgtggtacatgggggatgccggataggatatagctaggtcggacaaatctacggtcataacaattagtgagactattcagcaaatcaagatggtgcttaaagtatcccaatcaggcaatatgcttgtataggacaagaaggatatattccgagacgcctcgcgatgcaaagtggaaatccacccccaaaatacccaatacctatcaaactatttaaaaatcaaatgctctcttttgttgttggctcctatttggcctgggtagccaaccaagcctcatgtgccttcttctgacgctcccagtctttgcggagcttcttcgcccggctcttggtgatctcctcaccggaagcgtcgcgggtaggcatgccttcatcgtcccaggcagtgtattcgctggtacggaacatctccaggtggctcagcttgcccttctccgccttcttgagagcttcctgctggttcttcagcttttcagcctgcttttggcgagcccgagtttccttctcttcccgcgccttgagcatctcctgggtgactggccggactagggcaggttggttctcccgatcttcgagggcgataccaacatcgaagaggtcgatgtctcgcacacggtcgcacagggacagaatatccttgcctatagaatcagaggactccaaagagactaccttgttacggaagttagagaaaagctcagcgtacggcttagcggattcggaagcctcttgtggtgccgacgcttgggcaactgccgcctcgatatccttggcggagattccagccttggatcgtgcggcttcacggagtgtgtcacgcatggccgatagagggtacaggtagggcttggcctcctcggggatatcaataccagaccagccgatttcggtgctatcagccgaggcggtcccgttaagaccgaacatgttcaccatggaggttacccattgggctgcagcttgaacatcctgggagggcacggcggccttgtcggcaatattgaacttggagatgagttccgagatcgatgccatgacagcgggagtgttgaaagaatcacagagctggtcgtgaacggccttcttggccgtttccagatcagcagcaaaggtggtgtcggtacctgatgactggagagcggcaggatccttaaccttgaggaaaaagttgttcaccttctcctcccatgagctgcccgtgtttaccagatcgtctgtgatctcaacaccatccttccagccacccagcaggaagacaatgcgcagacttctcggtgaccagtctttgcgatcaagcgcttctcggatggtagtgaagttcttcaacgacttggacatcttggatccttgaatggacagatggcccatgtgaaggaagtagttaacccattgttcatgcttgtgatcaccgtgccagtatgcctcactctgggccagctcattgtcgtgatgcgggaaggcaagatcaataccaccagagtgaatgtccatctgattgcccagccgggctgatgccatggctgagcattcgatgtgccaaccagggcggcccttgccccaggcactagaccagcttggctcccctggcttggacgacttccagagagcgaaatcggaagcaccgcgcttctctgtcgttttgctggccaacgaaccttcaccctctgcagccaatttgttgtctgatcgactccatggctcaagccgagcgtacgggtggccggccgcttcgaaggcattgatatcaaagtacaccgatccatcctttgtagcatatccgaagttattcttaacaatacgatccacgaaggccgcaatctcatcgccatattcagtcacgcgagtcaactcggtgggatcaagaacgttcaggtcgcgcatatccttagtaaatcgttcctcgtatctcttagtcaacttggtgaagatgctgtgatcgtccgcgtcaaccgatgcacctttcagagcatcgagataaggcagaatgagatcctgcgcgtttgaatagaacgactcagcaaagagagcagggtcggcgctcgagccatggggggtttccgcctgcgcgaagacctttgcggcagacgcagccgtcttgatgtgcatcttaaccttggcctcgtcatcacctgccttctcgtttcctggcaaagctccaccgttcaagatagtcgcgtaggttttttcaacctcattttggtaccgcgccggaggggtttcggggtcgagcaagggaaggttcttctttaagtaggcgacgaaagcgcttttgacggtatctaagacctccgaggtgatcgtagggttggcggtgatgaattcgttaaacaaatgttgttgtctagcgcggaggatgatctataggatcggtgagtcaccgcgcttgaggctgtatccatatacacaaccctgattcataccttgtcgtccacgtctgtaatgttcataacgaagttgacatcgaacttgaagtagtcgcgcataattcggcgaataatatcggtgctaacatagtttcgggcatgtcctaggtgcgcatcgtcgtaaacagtcggtccgcacgcgtaccacacaactttcttgcccgcagagtcgatcgggacgaagggcgtcttggacttggtcaacgagttccacaccttcaatggaggcagttgcgcgtccggactagagggcggttgccgccatggcggctgctggcgagaagacatagacctgaaagaagtgactgacaataaaaaccgctgtttggacggtgaaaagaaagaaaaggaaagaagggagggtcggggggagagcataaagagagaaacaaaggcaatggagggggaggggctcttgtcaggaccagatcgactcatccatcaactgcggactcgctgtgattggcggcaactggggatgggaggaccgagccctgagccctaacgtatggcccgatcaggcaatgagcatgacatactttttttctttgcggagaggcaatgagatctagcaagttagggattgtccacacccattaccctcactgataccgctcaccatgacttccccattcctcacacggaacactatagccgacaaagatagccttgccctcttgcaactccgtcgcgaccagatcgttccgaccatcctccgcgaccatgacgatgagaaccaaggctattgggaaggaaaggtcaccaacacccgcttcggctcgttcccacacagcactctgatcggacagccctggggctcgcagattgtcgcttcgaaagtcgacacaggttcgcgcggtcgcacccaaagcgccaaacgcaaggcagaggagctcgatgccgaggcaacaacaactggcgcagaagaggagaagaagaagccatcattaagagcccccgtctctgcagagagtgggttcctacacatccttgccccgactcccgaagcatggaccatatctcttccacaccgcacgcaggtcgtctacaccccagactacagctacatcctccaccgactccgcgcacgaccggggagtacagtcatcgaagccggagccggcagcggctcgttcacgcacgcctccgcacgcgccgttttcaacgggtatcccgggacagaagaagcgacgaaacggcgacgtctaggcaaggtctgcagtttcgaattccacgaacagcgcgcggccaaagtgcagaaggaactgagagaccacggtctcgacggcatagttgaggctacgcatcgcgatgtctacgaagacggattcctgttgggcgaccccaaaaccggcaaatcacccaaggccaacgccatcttcctggatcttcctgctccctggctcgcactgaaacatctcacgcgcaacccgccacccgggcaggaatccgccctggaccctgagtccccggcttatctgtgcacattctcgccctgtctcgagcaagcagagcgtacaattcgcacaatgcgcaagctatcatggctcaatatttcaatggtggaagtcgcccagcgtcggctagatgtcaagcgggagcgtatcggtctagataccgagggcgttcgtggagctacactgtttcctaagaccgtcgaggaggcagtggcaaagcttcgcagtgatgaacaacgtgccaagctcatccgggataatcgattgaccaaagaccagccagattatcagccgattgcgaaggagacgccgttctataaagagaagacagatgtccccatatatgctcagggtcgcttgacacatcgatcagagcccgacctccgaactcacacctcatacttggtctttgcgatcttgcctcgggcttggtctgaagaagatgagcaaaagtgccgggatcaatggccatctgccaaggtcgttagggccgataatgaaccgaagacaagcaagaagcaaatgaagagacaggctgccatggaacgggcaaagctccgcgaagaacagaagcagtcggcggaaaggccacagccagattcgggagataaggctgaggaagaagagatcaaggaagaagagaccaagcaagaaagcaccgaggcatgagggtgaacctataccagtgatttgtttcattagcataaaagttccacaactagaatggcgttggtggctttgaatacagtctacgtcgcagatatcatttactcaaaggctctttcatcactcgcattgtacgcaatcctggagccaagctggtggtcatcaacctctcggtatcaaaccagcatttgcaatcctctcagaggcagaagttctttagcggtcatgaattgatcgataatccgcttgaacgttaactcgaagccgtttatttacacacgcgaaactggcttggcctaagaagcagtcgtcgtgcaggctacctgagcaaaacaagcgagcgtggatcaatgataatcgagcagcgaggaatgaatactacaggtgatcagaaccgtaaagaaggcaaccgctcatgtggaaattctctataggacaagatgctatcaaagccgccttctagataataaaatcatgaaatgcaataagcgaagtaatgacgacgtcgtcgggtagatggtatcgacagggaaatagaagtgttcagaggttattttcagctctgaacttatcccaggcttcatttagggttccgaacacagatccagcaatcatacgctgctcagtagtggcagtggtagggatctaaccgggaacgttagttggataatcagataaaatgcagctaatgccacccaacaagggagtaaacataccttatcagggtgcaccttggaaatgcccttcatatactgaatcttaaccttattcggcagaaccagctccgacaagccaatcttcttccacccagcctcgggccatagcacagaatccaggctacccagcagcgcgcgcaaattgtcttgcttgccatttctccaggcggcaattttcgcgtcgacgctctcagaaagagcaaatttctcttcgtcggcgcgctcagccgcctgattggcttgccgcagacgactgactgcttcaaagtcagccccagatgctgacgtggctgcgagatcggacatagccgaaggcttcttaggcgggggtgaaggccttttcctagcaggaactgcgggcttagattgaggcttgctgataccagccgctttctcgcaacggttccggccttggatactcgtgctaccaccgtggccagactctacagccagcttccatgtctgtgcggcatcaccccagcgctcgagttgctctagggcttcggctttgcgcatcaaagccttgccaaagaagtctttcatgggcttaggcgcttccccggtgcatagatcgatcgcctccgattcacccttagacgggccgatgaacgttaggatgatgtcggcatcatcaatggcggacttgggttctccgatctttagggctgtcatggcacgattgctgcggatgataatggtgataggatgcttgtcagggagcataccgagagccgtagagaagctctggtgggcttccgcgtagtcacctcttttgtatgagtctgcggcctttccgcggtgccggtgtgttgattgaagtgcctcttgagatacaggcgggatagaccgtgttggggctttagggcgtacggggatagaagctgggcgagtcggaggcgtggcagtctgggctggggtaggaagctttggacgactagccgaaggggcgggagaatcaaagagatcgacggtaggttcagaaggcggtggtggtgcctgcggtcgcttgcgtctcgcaggactaacatatgcttgcgctgtctgctcttcagccgcaaaccgtgaaagtcgagatttaggatcttgagaacttggtcgggatggacgctggaggaagttggcttgctgtcttgattgcacagcaccagggggcgattgattatgaggctggctccttgggtcggggtggctttcacgaggacgagggggtttctgaggccggccatctccagactcgagaagaagcgcttcattagtgaattcctgctgttctcgttgtggttgagccggttgatcaagacgacctggacgctgcggctggagaggaggttcatcttgtggagaggatgcatctctcatccaacgtggctggctggggtcatgctccgcgttgaattcgtttacggcttgttgaaatttcttactgccagtcttccaaagcgagccagctgatttcagtaagttattaccaaattgagaggcaacctgcgcagggtctttgtcccccgatgctggactccgtctatcctgacgtgaccgagattccggcatttcttctctcatccacgaaggccggtcacggttacgactatcgctcctttcagcgcgatcggcaggacgagtcgcactgggatgtccttcggtcttctgtcgagactcggcatgagcctgggtaagaagccaaccaacagcagcctgtacgtcggtcccagactctgtggtattcaaggcccggcgagatttatctgcggggaatcccatatccaccaactccgcaagagcccgatcgacctcgctggaaggcataggagatacatcttggtctcgtcctcgatctgacggtgtggcagatgtgggaggcggttcctggcgtgggatatccgataccggcttcccgagcaaaccaaggaaatcatcatcgtcgccttgttgaggctgaggagcgggagcaggttttggcttcaattgattgaggccgaatgggtcatcgtcatcaaaggcgcccatccccgtgttgtcctgcatgataattccaccattggaaggttctggccgactgttcatgtcgatttgaggcgacgctctcgaagaggtggggactgggaaatgggtcgacgcatccaccggcgctgcagcatcgaacgcggccagaatatcctcatcgtccgtgagcagtggcgcagatcgagaagcaggtacagacgcggggctctgcctacgtccttcaaagttgtcccagaattgattgttctggcctccgtactgcgattcaaatcggctgcgattctcggcttcttttttagccttttcctcctgcaaacgcttctgctgttccatgagagaaaggttcttgtttccggcggaagaattgaatgagaccaggttcgcaaagctatctccggtagaggtggcgggcttggatggcgagcttgagcggttcgaggtcgcggataacggggtagacctgccagagccaccatttgatgatatacttgggtacaagtacccagagctcagtggcggtggtttgcttgggtttttggaatcggaggaccaactcaagccgtttaggtcctccatggtgagcttgtcgcaaaggatagaggtgacgtctggtgggttcgaatgaggattaggtcccaggagagggatgaaggttttccatgatctcaccagctcacaatatgaaagaagcccgaagtaatttcaacgaccgtttgctagcaagcagatgcagagacacttgccccctgcatgtgggggatccagaccgcattgcggccggcacgtgatgctgtggtttcatctcgcgcattttgggatagcttcatttcctttaaatgctgtctggggattatcagtttattatatccaatttctgacattgaggctgaaagcctctcagaaatcgattgcctctaacatgaaaagctagttcgaggcatacgcaatgacgccgatgtgagagatatctcaatctagagaccttcaacttcttcattttttacactatattttgacttataaccaactaaataatcactcaaattgccctcgtcctcgccgtcgattcctaaaagaacatgggaagtattcgcagagatcaccatagttgctccgcccaactgaccccacgaactcggcaaatccgatggttaaatggaaaagagactacctaacaatacaccgacaacgcatggtggatatatatgtcacccctcacccagatccctggtgatggatttgagtaggccaaggcactgagaaaggctctaaacatcttacgccggagagaccatggatctcagttttatcggcaagaggaacgtgcctcggccgttaaagctattcctgtaaaaaggcaaggaacggtctataacagacaggagtgttttgtcaataaagccagctggcacttggtgttcccacggtataagcttttgcgtatttccccaatgcctgtataatgaccagatggggtatccctaaccacagccaaacaacgtacggaatacttactccgtacagatactccgtcctccaaacacgttggcaatctaagcggcagaaagccaaaatctggagaccgcgaagaaacttgccctcgaagatctagacatggcaagccagcggaacttaaactaccattcaatcgtaatggaaagggatttcctggcctccagggcctaaattagttgcagatttcgctaagttagttccatttctacttttggcgaacgcgtatcataccccaattagggacgtcatgggcggaaaatacaatactcggaccagtctagaactattttgtcttttctggaagcatcaaaaaggggtagaggggtagaggggtagttggagatgcaagatctacattattcaccgtaagttgtaatccatatctacatatgtatttacgttctctcaagctacaaatgtacaacataggccgtactcagtatcccgtatgagtcttctttggaagcgtcaataagaggccattgcatcattcgctaaatccatgttcgatcgtttaaggtttagtgaaaagcactaattgagaaaagcttcatgcattagcgcgcaggctaatgaagtttggcaggaagatacgagaatcaagaggaatggcgcaactctcgcggcagtccagtccccatagtgcccaccccctcttcagtaccccgtatagttcggagtaaatgctaaaagatccaagggccacagaacccgccgtctttcaaagccgcttgtccgggaatccgggaatccgaatggactacccaggatgcatgtatgtagtatcaagggcagcagtgcagatttatatagttagacatgcaccacgtgcgtacatcgttaaccctgtatgcacataatccatggctatactatacccagttcccttccgtcccgacgatcctaagttacctttgtacgtattaaaatgctaaagtggaccgaaaggtgcaaataaaaatggtatcgcattgtagcaagaagtactccgtaatgtccggctaaaaataaagagcaaaaagcaaagaagaccagtcgtcacgggggctgatcttgccagattcgatggcgagggagacctcctcctcaatgggctgggcagtcatgctggactcgccagcgacggtctcacggtaagcaacgacggggaacagaaggaccaacaagacaccctaaaatgaagagcaaaaagcaaagaagaccacacaaaaggaccaacaagactccctaggcccgctctacaaagattatcaactcaagggattcggataaggccttgcagcctttatagctgcaggcgaccaactgaatatcctcagactgggtaggaacccgacggcctgtctgggccgagctagaaattgcccccttgatgaagtccgcgctggcatactccactgggatttgctgctgcgcaatctccagtgggagatgcttccatctggcaacccatgcattccaagattctagatctggctcccagacattggtactgtgcatgtctgggtctttaaagaccataatagcgcctccagtccgaatataccccaatgcgaaatgtagggtgttcgcagtgtaaaagcctggaccaaattcattttcagcattctggctacttctctcagggaaaaagcaggccaatgttgattccaatgcgcttaaatttagtccccgaaaccaaagattttctgattcaagcggggcaccgatgagcttcctgatattggcttctagccgattcaggttcttgtcaaaacgtatcttgacacatttaacagggtcctgtgctttgacccgagaggccgggtagagatcgcggagactgtgggtttcaagctcccctttgatggcggtcggtacggtactggtgactgtcgttacgaggggcgaagacatgattggagggttgttgcccgaggcctttgcccatatcatgggcggcactgtcccttcctctgcccgtttgtctactggccacaacaggccagccccgaagggaacgacttcgatatcgtcttcgatgacgtatgcggggtggtcgatggcttggacgagttcgtccaatcccgccagccatgccaggctgcgcaaggggccgatgatttcagtagattctattgtcgtacatgggattagctactgagttcctagataaggaaggacaaaaaaaaagagaaggggggggataaacatacttcgttgcccattctcgtccagccattcttggatgtccgccgggatctcatcttcaggatatccctcgtggtatgtccatataggtctgaaaccatgcttaacgaggttatgatggtttcgtgggtaaccacgagctaggacagcgtcaccctcatcataatcagaatcaaaagtttcctcttcctcatggccgtggccttcatgtgtcggcctttctctatcagccatgctggcgagcgacagtttgtcttcagctaactcgaggaactgcggctgagtggtgcttgcgttatcaataggggttaatggctcgtccgtctttaagctcagcttcaacatcagcttcaacatcagcttcaacatcagcttcaacatcagcagggatagaggcgatcctgtccgcttccgctttgggtttcggagattagataccactttgaccaacttcaataatttgcgagatgggtgcacacagttactatatgatattgttgtgttctatcctctatggtaatcacatgtgcaaacattatggctgttctaaaatggggagctacgtatgtaatctttatctactggcaggagcgacctggagacttgtgagtacgaagacgtaactatgttgtagtatatgtaggcaccagctgccaaaacccttcccgggaagtactgatgccttagtgcctggttttggcctgtgggcctgagttaaaaccgacagaagggttaactagttacctacctaggtagattttgtcaccatccatggatgtatggaaatgaggttttttgcactatacaaatctgtgcatacatttcaattttcaaggctgtttatgtttccatatactcattttgatatacggaggcataacccgccatagaaattggagacgcatggatttgtatagtgccaaaaatccttatttttacaagctcatgatttacattacgttgtacagagctgtgtgtagctgccaagcggtcaaggaccaggccaaaatcgagcatcaaggcatcagtatttcccagaaaaggcagctggcgcctatactagttacgtcttcgtggacctctctattatgcatgtcatacaaacatccatcaatcctgtgagtctcccctctcatttctgagtacaacacccatcagaaatctttgtcttccgtgggctggcttcaccgtcacaaagcataatccaaaatccatctgagacccttccagattgtctcccacactgccgctttctcggttataatgggtgcagctattaccttttttccaacaagactccagtaggtgtcctctgtagacttttgatgatctagatgccggtaagcggttctagtctactactgagcattgctatgttccacttgacttcctcacatcgacaccgcccatcctctatgaacacattcacacttatccgcatctcgagacactcttcacggtcgactcgcttctgcatgctttggatactctttataattttttacccactcatcgcctgtctgaagcctccggaacgtgcaactgtgagagacacgcctgggaaattttcaaacattccaagtcatccttcatggattcttggagaatattttatttgagcttttccaccccctggctaccatgcgcaaactaagaatatcgcggtccaatatcacagccttggtcgggatgttctgtctggctccgcgacctttgcgtacataccaaaccatctgccatttgttccaacatatttccgctgctttatctggtaattgggttcgcgcccattgaaattttgacaacaactgattattcgagattgattgcactttatgattacattattaagaactgcaacacggtgggaggcctttacggagaaagagcgtgcgtgtatagcttttcttattggtttatcccatacctagtaggttaacgaagtccttaaattgatattttataagcaagctaaacaagcgacctaccgaaggtatcttgctatacggagcactttccttggtattgactatgtgccaaatatcagtagcacagcctctaatagccgtatctttagtaaagaactgtcgtagagttgatcgtctattcgtagacctaactccccttttttaggaagagaagccttcagttaatattatccatataagcagtacctagtagggttagattccgtacctaggtaagtaaaagtgataaataatctaagtagattgcgggaattccgtccctaccaaggttcggggattacaaggtcttggcgactctttagtatggcttcaagaggaccaaaaaagacgttaaaaaggatatggaaagaatatgtattagagatgccagtgacaaggccaatcaggctacaccttgttatacttctatactccgtacccaggtaaattgatttacagctccgaaccggatgtatgtatccaaatcgataatctagaccaaagtttaggcctgcatatatattgtatcattattgattatgataccccaatttcagggaaaatccccgcgttgtcgagatcctaaaaatgagtttcctactattgatatactatctagtccttagagcggggtaactataaagagtcctatagtattccaagtgtcttctatgtactccgtactatgtcttgacaatgctatgcaacggagttctccgtgagtatttgtgaccgagaagtgttttacggtagaaaggcaagtcagaactccgctttttctcagaaaaaaacagcggaacctctcgggaggacgagcacgggagcgaatggaaatcaaatcagtggatctttcgcccctgactttcagggctcggacaattaatagtcacttcacacaatactcaattattgtcgccaagtcaatatggatacaatgtactccgtactccgtgcaagttatgatccgttcctagctgccattctcagggaaaagaaaagaaaggaagaaaggaaaagggaaaaaggaagaaaaaaaaaaaaaaagaaaaagaaaaaaaaaacagagttaaactgaaacgacccagcagagtggccaggcccgtgcttcccgttagctgggtccttgcattatcgtataaatcgtgctccgtataaatttgggcttaagtcgggagatgagctaagagttggaatgttacatttaaaggtcgaaggatttcaacgtcatagaagtatcatccttcacacccctgcactctccactatactacatgtatcatgcattgtatctattcgtgacaaataaggatcgagcctgcaattactttataacgtctagacacatttccggaaagaggggcagattgcgatgtgaaaccttgaagtctggccttgagagacgtagttcatatttatacatgggagaagcgacaccttccttttctagctgataggggtaatgctggccaggacacactttgatatccgagtcagttctccggtttccggtgtacggtgtacgttgtacgctgtgcgttgtactttcccatactccgtacaggcgcaccttgggggttttacatatttatgtctgaagtcccagaattattcccctaaaacgcagtctattattaattattacccataataagtgaacttaatccataaaatctcgaacatgcgcttgtttaaccagatatttacaaggaaattaacgcgatgcgcgatagctgaccattcacaccattgaagtacccgaagtgggttcgagattccgtatagggcaagccgtgcctttcatcattttatcattttatcaatttttctttctttttctttttttgcttttttttgttcattgaacggtacgctagtccgtgcatttccgcatgtttcttggtctgatcgaaataatctgcatctgagcgatctatacacgtaccacctggtggcaccttggaccaaaatttacctgatggttccattcccatctctccattctctgagattctccgaggacatgattcgtccattgccacagtgaaatgatagtcccttctcttgctttccgactggcccactccctccgggacccatccccatacctcatacggcaatcggtcctaagctgcgggaatggtactccgcacacaacgcctttgtgtgcacacgtactacagctattattgtagtaggaagtaaaatatactaggcatgtactccaatgtacaatatacaccggtagtcttaaatgcaaatcggcccattgagctaactatgtagttgcgtacccggtactctgtaccggttctgcataaagtacgagttgtggattaaaccacccaatctcgctcttcttctcttcgatccagacttcgccggattccgacagactttaccagagtcaatttcccctaaatcgactccataattatgcaaattattaaccctcggacgtctagcccgtactaaatggcccttgtctaggtaaagagctccagtcatcaagccccataaaaaaaatcaccattattattctacctatttttacttagtttatacccttagagcctttattatgttattttagtaaagggaagggaaaaaataaaaaccagaaaaaaaaaaaaaaaaaaaaaaaaaacatcagaacctccagatgtcacttcccccctctttgtgaactccttatccgaactacctacattctcttcgcccctcctttcgattactccactggcgccccctttcaacctttgagtcccaaggtctggggtgaaactcccaacacacgcaacaatggggctattcaagcgcaaagattcgaagaattccattcaaagcgagaatgagaacgattccttcgtatccgtcaacagcgctcgcacatcaaacacatccctaaggtcgccaggatacaagggaagtggtccaccagcttcaatcccagaactccctatcgccagacccccagacccagcattggacccggctgcatacctacggagcatccatgcagtgcgcgaacgctccaacatcatcctgaacaaggccaaacagaaccaactaaaccatttcgatgtcgacatgagcaaattcgaagctaccgcctcctacgtcgtctccataatcaaggtaaattcagtgaacttctacgatcatctgaagctgcgttaacacgtcttcccaaccagcgagattatgcgccagactatgagaacattccgccgcatggtcgctggcagcatttcgacgttggcggcagaccgcgcatcaaccagctcctccagtcctggcccagtcgcattgatgcgcaggaacgcacacgccgtttgattgatttgtttgtcgtgtctgttctgctcgatgcgggttctgggaacaagtggtcgtaccggtcgaaggagtctggtaaagtcttctcgcgcagtgaaggcttggccgtggcgagtctggagatgttcaagtcgggtcttttcagtagcgatcctacggagccatgccaggtggacggtgcgggactgaaaaaagttacagccgaggtgctcgccaagggaatgcaacattccgaacaaaacccactggccggtattgaaggccgcgcagggttgttgatccggctctccgaggcactcaacaatcaagacttcttcggtgtggatgctcgaccgggaaatatgctaggtaaggcgatctgatctgggtgtgtgcttgatcagctactaacctttactcagattatcttctcggccacccatcaacccttgcttcttccgtaccgattgttccgattaccacgttgtggtccgtgcttatggatggcttctctcccatctggcccccatcacgaacgcagattgatggagtatccattggagatgcttggaagtgctcgggtctccccgaatctcctcctgcaaagcagtgggagagcatcgttccattccacaagctgacacagtggctatgctactcgatcatggttccgatgtcgaaattgatgtccatccacttcgccggtagcgaccttctaacagggcttcctgaatatcgaaacgggggccttcttatcgacctgggactcttgactctgaagccggaagatatgcagcgtgggatcgaggcatataaagagaatgcccagatcaagggtcagccaagtgtcgaagtggcaccgctcttctgcgccgacgacgatgtaattgtcgaatggcgagccgctactgtcgggttcctggacgagctcctagaggaggtcaacgctcagctggggcttaagggctctgaggagccactttcactagcacaaatgcttgaggctggcacctggaaggtaagcacgaagcactcatcgaggatccccagctaagtaaatgctaatgaacctacagggtggtcgcgagattgcggaagtttccagaccaaacaccaaggaaccccctatcatgatacgatctgacggcactgtcttctaataccctctatccccattttaattgcttggatacctgcataccttcgtcccgtcatctggttttgctatttgggacgagcttttttgatgaaatgaactcttcatgaccgaataccttcatacctatatctcacgtttggcttttctcctttttttctaccttttgccttttttttcccctgccaccttgggctttttcctctttttccctctgcatttgaggctattcactgatttaccattggttttgggcggcttatttcatattgcattttgcacattcacatttcaccttttctttttctctgtctattgtttcactttgccctgacgatataaaagccatttgaccatagaagatctgtgatttttcgggagacccatgggatgtcgtcatcccgtaacctcggccccaagctcaaataacaaaactccacaaacaatgactaaatgtgccatccagtgcacaattgtaaagtctcatgacctggatcagtaactaatggaaaatatcaaaatacctatgggcagattgctagactcatcatccgcccaatcctacctaggtaaccttctccaacaagctaacaaacaatcacgtgttctggaacaacattattccgtccccacatcagaaggtcggagctcaccccggggcctgtcacctttccttcttatcttatgcactctcgccctcaatcccattgtcaagactgaagatgctaatattagactcctaactggaatctaataccattgcatctgagtgaccctgtgaaggcactgagttgccctccaggtcgacccgagttatccccgcaagagcggggcattgagctcaacggcaaacccaagaacatcagacaggatggatgctcggaagaagaagagaaaggtgctcttgatgggcaagagtgggtccgggaagtcgtccatgcgctcaattatcttcagcaactacgtcgcaaaggatgtccggcgcctaggtgctacaattgatgtggagcacagccatgtcaagttcatgggtaacctcacattgaatctgtgggattgtggagggtgagtaatgcatactcgacttccaatccgggagtcattccactaacacggaactttcccatctcagacaagatgccttcatggaaacctatctagcctcgcagcgcggcaacatcttctcagatgtcgcagtcctcatctacgtattcgacatcgagtcacgagaagtcgagcgggacctggacacctaccacgcgataatcgaagccctgcgcgaattcagcccaaacgcctacgtcttctgtctcgtgcacaaaatggatctaatccaagccgagcaccgccaacgcatctacgaagagcgctccgcggtaatccgcagccgatctagcgacttccgcgtcgacaccttcgccagcagcatctgggaccaatcgctgtacaaagcctgggccggaatcgtgcacaagctcatcccgaacctagtcgtgatcgagcgcttcctaaccgccttcgcgaagaaaataaacgccgaagaagtcatcctcttcgagcgctctactttcctcactgttacctccgtgacatctgaggtcggcgacctcaatcccatctacgaccgccacgagcgtctctcgaatatcatgaaggcgttcaagcactgcgctgctcgaaacacactcaccaccccggcttctgcgggcttcgtcgtcatgcacactaaaaccccccagttcaatatcttcctcggccgcttcacggataacacctatatcttcctcgttgtgcctcccggcgaggcttcgtacaactgcgccgtgctgaacaccatgcttgcccgcgagggattctcaaaggcagctgccggcagcggtggtggtgatggattccctcttcccccgccagaaacagcggaggatcatgcgacgaacgggaatgggaatcccgcgtgaaatggatggatgtgacattaggtagctaggggatggtgtcttttcccccgtgatttccgacagttttatgacaaaatacagcaggtgctgaacgatggcgttatggggattaatgtacttcttttgcattcttttcttccttttcaacccctcttgagaattgagataccctgtgggatttctttgtactgtttttcttctaaaaattcatgaaaaactacctaggtactattcttcaggctattaccaaagctcttgggttttatccaaaatacatatttcttcaagcgacattcttagcgacatggtgttagaccagtttttgatcgcagcgatcaagtctgatttccaactaaaccattctgtgacaggaatccacaccgatgcttctgcactttatctggattaccttgccgcatagcgcacagaggctgaattgctacaatgacccgacaacaagacactgaacattcatcgcatttacttcaaatacaatactggacataagatcccatccgaaccatctatattcctcgcatccgatgcagaaagcagccaaaggcagaagagagaagagtaagaacaagggagggatttgattatctatcggaccggccggcctcaacggagaaggatgggggaaaagggaggagcaaaaggataacgagaacaagaaggggatagaggagacggaggggggctgtacaaaatcaatcatgcagagagctggaacattttcattggacttccggcatgcgcatggcaatgtcgcccgactgtgtgatgtatcgcacccagggaagagaggggtattgcagctgtgggatgttattagccatgaatccgagagataaaaagagtcgagggaaattccctgctgggaaagacgtaccttcggttcggtgatcttgaggtatcgcacttggatgccactggtcgtgaaataggggatctcgaacttgacgttgatgggacgtttggctttgcctacacctccggctccgcccatgctgcctccgaagccgccggtcataccgccgccgcgctcgtcgtcgcccttgacggagggtaggcctagctctgcgcgcatgaggaattccttgccgccgccgaattgcttgatcttccagatgatggcggacttctcgggggcgtagtgcacggttccgatatttgtgcggaagcgtggggagtctgcgtcttcggggacggggacgagaatctcgacgttgttggcggtgctgcggcgtttgaattgggctttggcctattgtagaatcgaggttaggggatgacgtttgctgtgctgggtggggatattaccttgagcatatattcaattcgggatcccgagtgcgattcaaccacgcactccacccagatcaacggcttcacttgtgtgttcagtcggtagctcatgagttcgaattcaccgtccggaggaatgaaactgattgtgcggtcgttctcgaaacgtgagagtcggacacactggtggaacttcacgtcctccatctcgaccgacttgcctcgtgtagcacgacccgtggtctcgaacatggctttgtcgttcaagcccaatcgcaactctggcataccactcaggtagcacttcatcttgacagcgcccagaatctcggaccgcaggacgtttccatttgctgagacgagaagattgagggactcgaccacgtcgaggaagacttcgtttttgcggtaacgtatcccctcgctacgccaggagacagcatttgtgacagcaatcggtggccgtgcttggacatccagcttgtgtgactcttgggtgatgtatctgcccatagcgtagaacggtcagttatgctgtttcaccaccaccccgccgtaccattcagattcgactgcttactcttgtagaatcttgctctctgttgtctgcgggtatccaaaatccatcatctcatccagcaattcgtaaatgacgacgaagttatcccggatactctcctcctccagtaccttgaaatattcggtgaagacctccaccagcttgtggaggaagagtagaatttcggtggcatttgtgtttcgtttggtcaatgcaaggatatagaggttgctgtggcggatataaaggtactagacagaaacaccccagtgttagtaggtgggagcacacaaaaggagacactcaggagcgggtgtcgtatggtcggggcagcaaatgcccagactcggtggaacgcacgttgattccctcgtgagagaagcagggaggcactgctgagctttcttcttcggcgtcactgaggaggatagggaatttctcgactgcggacatgggaatatctccgcgataattgcgggccagaagggtctatagatggtcagcgggggcttgtccctgaacgcattggcaatttccccaacagggagtcgcatcgacatattttgcacaatatccagtagcctaccttgcccttgaggtcgaggaagaagagtgctgacgccatgacttgtcaatgggggtaaataggtgacgggagagttggtgatctggtctcttaaggtggggcaaaagcaaagaataacaaagacacctcatgcgcctactgcagcattgtcaatcaagtagtaagaacgaatagaatagcagttgatgaggtgagaaatgaaaggagcagatcagcggatgattgttggcgatgcccgcatgtcccaggccggagatatacgccaacctcaaagcggactagcgtataaaatcacacataaaagctggtcgcgcactttttaattttcttctttcttcaacgctcccaatagacagttcaaggcagtacaaagtccttgtgattttctacagctactccggcattctgtcggagtgctgtggtattttaattactaccttgcgatacagaggcgcggagactacgatcttaggagggttccataagagctggccgagtactttctctgttactcgggcggcgtcagaggaaccgtacatttcttacaaaacttcaattgaattatttttattataaaatcaaaaaccccttgtaaatcgtagtgaaagtccattaaaatttttgaacttgcaagttgaactctcaagtggtatttaatagctgagaaataagatgatagttataaaaagacaagtttgttaaaagtacatgtacaaatcgtagaggttccccgattgaggagttcgctccccagtcaacctaccacagatggaaatatcaaacaagtgttaacgccctgaaaatgctccaaaggagaccaataccccaagtctcagatcagacccttacgagaccgacttgagtcccaggggttcgagtatccgctcacgagccactttagtggcaacgactcctcccttctctaacgaaacagcgccgacgatagcgtacatggtatgcgcgagaacgagctcaacaccggaggcgcgaaggtcattgggctgcagtaaagacaattgttagctgagaacaagaaatagaccagagtcgaggcatacctttctgggactccatctgagaaccttctgcaactcgtacttgtttgcaagctcagcgagcttcgaccgctcggtgagaatcttcttagtctcaccagagaggttgttcaatccatccagagccgggtgtgtgaagggcacgcgaccaaactcgtccttgttctctaccggtgaggcgcctgcgtatggagcgtcctgcgccaaagccagcgacgcttgcagttgcacaatgcgttttcccaagaaggccaatcgatcgttgaatccgcggcgcccttggtcgaaacttttatgcgtcactgccaaccacttggtctcatcggagaggagtttgtcgccgccattgccgaacaatcggatgtagaatcggtctagcagtagcgggtctgcattgacatggaaggtcgggcgcttggagtcaaggtgtagactaaacggagcctttgctgctgcgggagtgtaggaccatcggggcttttcttgttgactggactcctccggggtagaggtcgcgaaggtgcgggatgggatgactccggcaattgggcgagcgacaaatttggacgcagcgcaggcggtcctggccgctcgagaagaaagattcaaagacatggggtcggtggtctgcgagtcgactcggagttggtcgaacggaaagcaaagaattcggactgggcggtgtgatactgccggtcatgtccaggtacatgtacacgagacccatgaggtctctgttaactgtcgaccacaccttgttttgtttttcatgactgtaattctcacaagtccttgctatgtagactcaggtctcttcaattgtcatctcggctgtttgacatgcagttaaacaaccttggaagccggaggcaaccggaccttcaccgctgctgcgtggtatcttttgctcgaatatgcttgacttgtgcatcggatccgaaactaatccgtactgacgctggtttcggccgtgggagcctaccgtgggagtctacacaagctagcaggctatggccgttggagctggaatgtacacaaacttccgactctgccatgcctcgatgcatgtacgatcaaaacggcatatgactcacattaaacatgcaagaaccttggaagccctgcgatatgggttatatcttagcgaccaggttatagtatctatgggatatgcttcgatatacaccataccgctgtttgcgggcccagatccagaacatatgtctgctcaatttgggcaggctccattatgatgcatgatgtgtatttgccccaattgtggattactagcagctttgactcctgtcttctgcgggctcccatcgttgaaactcgggcttcgacttggtgcgggtggtctcgcagatctccccaccactttatccagcaacatccttctctggataacatggccattatatgacccaacaggaaacttgtgctctcttaacttataggctataggtccaatagtcctgtcaggtaacatcgtccagttatatgactggctaacgtgcgatgcgagcagcggcgcaacagaccctgagcgcggcccaactatcagggccacaggtctctagccgctgcagaggaacggtgggaagttgaaaagaagaaaacagaaccgcaaagaagggtcctaggcaaccaagacccattcagcagaagcttcggtagccttctctcaacacagtcgttccgcagaagctgccgggtatgcagaggtcatagctcatagctatcgggagcacggggcaggcagtgttgttgagactgcttggttacggatatacgcagctggaaagctcggctgaggcacaagtggttggctcgaacaatccatgcctctctggactgcagaataacggccctgctgtatcagcgtaccctgagctctccccctagattaggcaagagactgtcatgtactgggggataaaacgtgacccacgtgtattggtattgagtcttgttcggccgtgctccataggtaggcttcctttttctcttgttgcctcttatggtcgttggaagcttctacggcttgcatatacattcgtctcacgactaagcaaattcgcaacccacaatgggcattgtggagacctagataaaagaactggggtatgcgaatgacagacatttgatatattcgaaagatcgtaaggttgaatgacacaagaacacaaactagatgtttgacggcctcgaattcatatgaatacctttgaaaacaacacacggctgttcaacccaaacattatttagtaaataacatcggataatcagccaacggcaaatcatctagaacaaacccagtgaaacagaattcatcaagacgctgcaagaaaccgaaagctcagaccgctggtgaaactccactgtctgcagttggtccgggggaaaaggatctatagccgcccattgcggatattatactatttgctttttcatgaatgctaatatgtctattcgagtggatcttcatctaattcccggtcgatgcttgcttccggggaaatgaaaagaaacgaaaccaaaatataatataatattcacaacagcgggtgtcaccgtactgtctaacggtttatacatcaagtcttcaggcgggcccttgcagactctaccgagatatttgatcttcacggataggagccatctccaaggtccacggatagcaacgggaatatggctatcgccaaacggcttcttgtcttgatccttgattgggatgttcgacgggatagcggtgtacgactatggatgacgcgacctattgcccccaggtaaacctgagttctcgaatcacttaaatagacgagatggacctgtccagattcctagtcttcatccttgagaacatcagagtactctgtcctgtgtcttttgcctgtctttcgttgaatatctatacttcctttctctgtcagtcctgatttgtgtgctccattctactatatccgccttcgtttcgtgtcattcggatatccaaatggctttcaacgctacttttgcccatggcttccagcccaccccttcatcgccggtccaggcatgttatacctctgtgggaaacgtcctggcttgtgatcactcggtgcaagatcctccctcaccacgacctttcccacccaatcctcctcctagtcctgcttaaatgacggttgattggggtcttctttgtttggcgttgaggcgatatagggcaataggtgagtgttctttatgcagccatgtcaaatatatagatctactaggtagatatatatcggcataggtactggaccacatgagcatctactaacttactttacagatcatactccacggcatttcaaccacggtctttacagcggggatgtgcattgaagggcgactaggatatcataatgcgatgtgtatcgttgtcaatgcaatatcagttgcaggaaaaatggccacgaggaacattggaccctgaggagaaaaaatgaaggtacaatgtgtgagactgaaccgtgagaatgaacatggatttcgagggggttatatacttgaggtgcttttctcattcgcatatccaccgggcaaaatagtaaagtctagacacaacgagggtgagcatgtaggctttcaaactccaacattaacatactgtagagttgtgcaagtagtctagcccaatccgaacgcaattccaatggaaataaaaataaacagctgaacagaagaaaaagaatcagcgccttttaagcttgcgccaattgaccagattcgtgtatatttgagaaaaagtcactttaataacacataaggaaattcggaggtatgaggtacggaaacattttaaatcaaagcaagaccaacagcactagcaatgctgaggccaaccacagtccagccagtcttgataatcacagggttggtgagaccacggccaagatcccacatcaaatggcggataccgttcatggcgtggtaggtgaaaggaagggccagggtggtcttgaggaggaccttggccgcgagaggaagagcgcccatggcagcgaccatggaggccgattcgagatgccaaccaagagcgggggaggcgaggtaagcggtagcccaaatgtacagggtgccggagagagcaacaccggtgatacggtgcagggaactgccgatccagccgatctggggcttgtagatagtgaggtgaggagcgacagggcggttaaggcgctgcttaacgaggatctggctggggtcctcggtgttcggggtcgaagtaacttgtctgtagaccagtgtatggttagtatgttcttctggcgattgtggatgacgtaggatttcgtgaggggcgctggattcgagggtgggtgaaacaattgaaactcgctgtcttaacgctgggtaactgacctcgtctgaatgttcttgccgagggcaacagcgacaggggaagcgcccatcatggacgaccgcatagcgagcggttgctggacggcaactgttcggggataagttagatcgcaaattcggacagggtaggcattggggggtaacatacgccgtcgcagcgactgctgggcaaccttctgagagaacattgtgattgcggagttgagattgttctgtttgatcaggataagaaatcccaagtggctcgcgagcgatcggaatcaacggacgacctcgggtacgggagtgtctagtcacgggactggcacccggtagtcggcgtccgccaatcagatcgtatctattaccagccggagtatcgttcttcccgacacgctactgcagtcatgtgatcacctcgcctgttttcccactttcttcggtccgcagctcccctttctttctcttcctcaagagtctccgctcacgtcgtctactggttttggctgggatgatgtcgtcgtttgctttccctcactgactgcggctttctgtcgtggacgccgagggatctcaaggctctcagaaggagagtcccgtcgttaatcgcccgttccactctaccaatgaggggaaggggtttcatatcagggatacatactgcatgtatcacattacttgatgcttgtagttttgccaggttctttggatatactacagtgattcaagtttacggcaactgctgaaatgcctgcattgggtatgatgaagcaaaatctagctgagacactcatgcttttgcgaaggtgcaatgttcgctcaagtctacagcccgcaatatataattcacaatggataaatcaaagcaatggtctttttttccctacttgtatctaaccgtgaaacactgtcagctgtaaaagtcccaggttggagatagagccattataaggtcatcggttcctatcacatgtcaagggaccacgacatgtatgtatattctttccttcacacctgggcttggtatttggtccacaggccaatgttttgatcattcacaagcagaacaaagggctcttggacatgtggcatatcttaaggtcggcctgctcagtaatccagaaattgtgccccagtgtaagagcccagatgcaacctcggcacctcggaccttccccacagcagataggtccgcggctgtaagatcggtttattatctggtctttcgtgattcaaaactatctcttgactctataccttcagaagcgaagaaagcaatcatactcgtgttagtatatctggtcccttgttcaagttccatgctcttcaagttattgactccgcaatcatcagattagataccccgactaaacaagatgcctttcaacacagccttaacgcgaaagctcggtattcgaggtgcgccacgggtacagtattctgcaaatatttccagctgctgatcatggatatagtgcccgtcgtgcagggtggtatgcaatgggttggatacgctgagctggcctcggctgttagcaacgcaggcggacttggacttgtacgtcgtatacgtttgaatgaaagccctaactacatgaaatatctaacactacaatctagctcacagccctcacccaaccaacccccgaagacctccgcaaagaaatccgcagatgccgcaccatgaccaaataccccttcggagtaaacctgaccctcctcccctccatggttccccccgactacggcgcctacgcccaagtaatcatcgacgaaggaatcaagatcgtcgagaccgccggtaacaaccccggccccgtcatcacccagctgaagaaggccggcaccatcatcctgcacaagtgcacgacaatccgccacgccaaggccgccgtcaagctcggcgtggacttcctttccattgacggcttcgagtgtgccggccacgtcggtgagcacgatatcaccaacttcatccttttgagccgtgcgcgccaggaactcggcgtgccgttcatcgcttcgggtggattcgccgatggccagggtcttgctgctgccctggcgctcggtgcggaaggtatcaacatgggtactcgctttatgagcactgttgaagcccccattcaccagaaggttaaagaggctatcgtcgcggcacaggagactgataccgcgcttgtgctgcgtcggtggaagaatacctcccgcctgttcgctaataaggtggctaaggatgcattgaaggtcgagcaggagagtaagactggcgaatttagcgaggttgggccctatgttagcggcaagcggggtcgtcaggtcttcattaacggtgatgttgatttcggcgtaagctacttgcataattatgtatgtcttgtgtttgctgactctttttgtcatacaggtgtggactgccggtcaggttattggcttgattcacgacatcccgacttgtgaggtcctgctcacccggatcgagaaggaggccctggaggcgatgagccggaccaggtctttgtttagcgatgctccctccagtaagctttgaagggggttttatgttacagatgtggtttcagtccgtgtatttagcttcctattgtttggaaagatccaatagaatcacttagttgggatatttctgacctggctttgtacatttgcatgttgaataatattatcttctcttcacgtgaatcgttcacgtcatttccggtgctaaaataagagccaccacacaaggggctggtcaacggtcaataataagcattcccgagcgagggtccgtgatattgtatcaaggatcaacacggaacatgcagatcctcggatactcgggcattccttcgactccaacctccaacaacaacgactcgaacgcaatgacggagtccttttccaagctgaactcaccccggtaactgcaataaaaaaaatgaatgaatgacatttgctctccgaaccctccagggctgggtcccctcatacaaggacaagaagagtggagacatccttgcatgaagtcgatactctggggaattcttggagaagctacatttccagcccggatgattggctctgtctcagttgtagctttggtttcttgagtgtgcttcctgctgtcgcggcctttgtgtatgatatcattcaccatgattggtctctcccccggcaacccttaccactcacatataccatcacgcttggtatgctttcacttccacttccacttatactatttagatggtgaggggtagaaggtctcgaggtaaaaggtagatctgacccaggctagcatacgcaatccaacttctcgagcaaatagacgatatcccattgcgttgcacagtaatacagcccagcattaccccgtgaagatctagataacgacatacctcgtccaacgtgtctccagcccagaactgaactcgaatttggtttctctctatccctcccgcaagttagctactcaatttatataccacgaatcgcctctctaccagctgttccaagctccatcaacatcaaaacaaaaccccaaccccatatctatcaatacccaccacctcaaactcaaccccagaaggccaactaccaaaatccaaaatgggcatcatatccaccctgacacgctgcatgcgaaaagcccgcctgtccaaaagactctcaacaacaagcaccaaactccacgacgaagactcaaacgatctaatcaaaacaacctccgaaacagcctctctgacccgcacaagcatggactccacctcaacaatggtgcaccattcggtccacgaaccagttctgccgtgcgagtcgcctgcgaaccgtatgcagatcgggacagataatgggaatatgcggacgttgttcgatgacgatagtactgccaaccagatggatcgtccgattttgaaattggattgtcggtcgcctgttgatgcgccgaggaaggtacttcaggggcctctggaagtggggaggaatggaagtctgaataaagctactgagaacaaggctgcatgggacagacctacagagggtgctggtggttatacgggaaaggatacttcgggttgttcgtctgcgacaacggcccagaatggctttgaacgtgagaaaggtgtgtctgagaaaagggataagaggtctatgtcggctttgttaaagaggcattgtgggctgaatatcccacgttcgtcgatttcgattaagacgtcgcgcagtgtgcagtcgccgagggggttggactctgctgggtttacggaggaggaggggttggtggataagagggatgagaagtgggtggatgtgagtttgaatgagaagaagaggaatagtgtatggggtggtgttgggcttgggagattgtggtagaagtttgttggggtgtcagtttgtatgtaaatagttcgcgttgtagttggaatgaaggcaaagttgaagatttacgtttctttgctaaacaatgactggtagaagcttgtgcccacgggggaagtggataagagcgaaggcagacacaaaagaaaaaaagtcgtggagtaggacgagggaagggtgaaggttgagaatgggtcactaaaggggcaggaatgcactgcaagggatgtcggactacaagggacaaaatgggcaaaatgatgaagtaggattgcactcgaagaagttctactggttcagaggaatgatgataatgcaagcaaatctaatgaattaaagtaatatatgcgaaagaaaccctaaccaagacagcagctgggggattccaatgcacaaagcaacaagcacacacaccacaaggtgataagcagaaagcaaaacattcttctttctccgagggtgccacacgacacaagttaaatgatacacgagatgcgaaatgaacaggacaatctaactaatcaaacaaaagccaaaagcctgcttcccattcccgaaatcgttaacagtccacatcgccagccatgtcgaactcggcaccaaggtccgaagacccggcatggtgaccggtgcttcttgcatgatgcgagaaaacaaagcgaagcgcttagaggatggagccaagggcaatgcaagggagaccgacaccgatgaggtcggagttctgcgagatatgttagtgatgatcgagaaacagagctagtgggagtactcacggcgctggaaggagagttctggcagcaggcaatgttctgcttgcacttctggttgacgaggtcctggagagggataccaatgatggggatctggaggtcgagcttggagcactggtcgaagagaccaaggccgttggcaccggagccagagccgatcaggttgctgagggcaccgccgagcatgccggagttgatgtcggtggtgtcaccggcgtaggtggccttgttgcagcaagaaagctgggcctggtcaccgcacttggcctgagcctgcttgacggtcatgttgtcggggacagcgaagcgaacgtcggtgttacccttgttgccgacaccgttgccgttgccagcgccaccggcgttggggccaccagggggaagagcgtaagcggtggcagcgaggccgaggacaatagcggagagagagaactgcattgtgacggtgggtttggaattgaacgagagaagactcggagagtagagaagattgaagaatagagaaggaaagcttgaaagagagtgatgcggatgaagagaaaactaacagagggcgatgaatggcctcgtctttatagatttgactggcggtctgtgagtctccctgactgcatattccagggccaagttgtttttgctacctaccaagatcatctccagtatgttttcggaatgtaactgggaaggaaagggagatgaagatcgctccactatgcagggcctgtagaccaacgagggtgcacctgtggaggttcctggtatggatctacttcccaggctctcacttcatgtgactagggagagccctggcattccctcgccctggctcatcagccctcagtccgagtgtccacaatttgtctgtaacgttagatgaaaacaggtgtaattcagctatgatatactcaatgttgatcttttttgaacagaccatattaacccatcaaaaccaaatcaaagtaagcttaagctcttccaagtgggtctacgttgtaagggcatacctctctacttcaacttcccacaggggcttttctccctttagactttgtctctacacttcgggagctaaggcatgccacgcatacactcatggcaatcgtctgactctgctgaggaggctgggattctccctctgagtggtcgaatctcccaatctcccatatgagggtcacctgcaagggcgcctactgcacctcggacactaaagctacgtagggagatctaagacactcccttcattgtttaatttgtttaatcttaacctgcgaggaattagggcgccgggacggtgagcacagggtagtatccccgtgaagtctccgattgggcgtattgccttccgatcataatctcgtcgattactaccaagcttcccccctggcggcttctcacaggacctgaatcagtcccctttttatggtctggggttatcaatagtgtccccttcaatcaatctatagcaatgtttccccttggtctatacgtagtccgcattactagtgtactttggctttcaaatgtcgtctcgtatcgcatttttgggtcaagcttttggcaatattgagaatgatcgagatcctgctagactcattctaatgtatatcgcaattttatcgctaggagttttatcgactatagacacacttgaggatgatatgagaatgtagaaaatgacgctttgatgtcctttgcggtgcccaataggcatgatatagtacctcattctagttgaatgtctgttaaacagtagtctagcagttgaatctagaagataattcccagagtagggaaactccagaagtagtgggcttactgtccaccacaacgctggttgatggtggaccggcagttctagtagtcttcatgaaatcaatataccaaatcctcatatttcgatgctgaatatatttctactttccaataaatgcttcgtttcttttaatttacccaattaaagtggtatggattctctatttggacgtagaggttttaaatatatatcctgaggggttaaggagagtatgacagttccagatatatatccataacacaacaggtacatttagttcaacgcataacaataaagatatgttgcaattctttaacaagtccaatcttactattcacgaaatttgaatatttagtacacaccacttggtaaacccgtatacctgatagtccatgttcgtgcaaaccaacccgtcaaaacattgctctcctgacgccttccacgtttaattaatctggaaagtatttccaccggtgccattaaccttactttccaaggtcgggattgatccaatcgatcctttcagttttgatgaggagccgcggtctccaaatcgccaaggtaccccaagaagcacgtcttcgaacgcggctactctattctagggatgtacggagtactagacacaagagctagggtgcccgcaagctatatctttgtaaaacatctacttatccgacaaatctgtgcggctatcttgattcaagcaataaatagtcctcgtgagataccaagggaacagatctgaaggcgcatctctcgagaaattctccaatcccgaaaggaatcgtctcacaacgtcttcgagggcatagggacattcctatatgactggacacgagaagccagcaagagatttctcatctgggaaattgaaatatcgaccgcctaagttttcattcgtgttgaactcctttgtcgggtcccccttgttcaacgtaccacgtggagtcttccttcacaaccccggttctgtaaaggctgagcaagttctggtcgacattggaatctatagcagctctatgcgctattatgtgaccaacttcctaaactaatagagaagcaagcggaaggatatctcgattgactcgctcgcttcggtgagctcccttgcataactcttttcgtttcaccctttcacactctgagtctagagtgcggaagcctgtctaaactcgggtttgaagaattaattacaaggaaagctcagaaagcgtagagaagagacggcgaaagtcgaaataaaagatatgtgcgagactgatcttttggatgagaaagactatgggcaggatgtagtcagtcataggaacattagaagttatttgttgtccggtaagatgcaaatctgcagggatggtatacaactatgcaaagggagttaatttaaatatgtgaaattaaatagcccgatttgcttccaatgtcacgtcaaagtcagtcttcgagaataacagatcatgtatatagttactctaattattcccagaaagtaaacattaatcagaccgagctatggtgcgcattggcttgcaatcaatacatgcaacggaacaaatagtggtcgtagtgaagggaagttcgtcttctcaggatttggacaagaagattactagaataaaagcgccaaaaggacaataccaaaagcccagaaattacacagaggtagtttcgacccaacattgccgtaaataacagtttcagttggcttggatgctgtgggcttggagatagtcgtcttgggagcagtcggtgtgatattagatgtggtgtgggttttgcagctagttgtcatcttggaggacgacgcgtgcgcatggtggccggtcttagaaggaggactggcagtagtaacgactaccagatccacagaggttgtagaggaacaagtgaccgtgctgaacccaacgagcggaactgttgccgtatgagaggcccagctgatggtggtacaaggagcctgggggacggacgtggctacaccaacagtctcaacgaatgtacgcgtattgctggtgatttgaggaacagctgtggtcttaggagcggggtccgaagtagtgcaggttgtagcgatatctacaatagcagggttctccggcacgaagggggcgcagataccagcgaagaaagcaagggcggaatcttcctccttcttggaggtgctccaggcccgaatgcatccgctaactttgtccgtgaactcagtggatggacagaagcatgaggcgtcgctgttggagttgcactttggaatggagagccatgtgttgagacatttgggtaccacgttggggcagggcgcagtaatagcaggtgggctgggcacggtggcggttgtggtgctgatggagctcgtgaccgggggatgcgaatgctcaatacgagatgatgttgtgctaggttccgtttccacaggcttagaaggacagattgtggttgacaacggatatgttgaggtaacgaatacagtcgaatgaccagggcagttagtgactgtcggtgcacatttggtgatggtgatctcctcagtagtccagactgtggaagtcgtcacccgctgggaagagtggctagtagtcgggggatccgaatgaccgtgaggagatgttgtgctaggtttagtttccacgggagtggacgggcagactgtggttgacaatggatacgtagaggtaaccaaaacagtcgaatgaccagggcagttagtgactgtcggtgcacatttggtgacagtgatctcctcggtagtccagaccgtggacgtcgtcatgtgctgggtagagtggctagtcgtagaaacctcctgcgatgtccaatggaaaggaggcagggaggtagttgaggtcggactgggctcagtgtgagagtgggaagggacaaggacagtgtgacctggcggcttggttccagtggaacagtcaaagtcgatctgatggatctctagatcacaatcgccgaacttgctcttttcggggagcgtgaactcaactgagacagcaccgccacactggtcgttggcgacatcagttcccctgtaccagctcgaagtgacatgatgacaggaagaaccatcgggcatcttgtagatgatgaagacatcagtgtcccgggaagttgaaagatggaagtttcggatcgagaatggagcatcagcggcggaaatcttgattgtccagttattgtcacgagagagctttcccccaagacaagtgcccttcaacgagttagaatcgagagccttttagaagtgcaactgtcaatgacataccccgtaactagatccctgacagccattcttgggctcgagcccaacgaagtggaagccctcaaagctccaattgtcaccatttccgagctcagacaagtcaaagcctttccgctgaacgtccgagcactgattgtcggtattgtctggactggtgtagcagacgtcggtaccccaccactaagaaatccccaagtcaggccagtgtggttcgggttgcagaatggatgtactcacaaggcctgctggatgagctagcgcagcaccaaaaagcgcaagaagagcaattcccttcataatgggcaaagctgtcttagttgaagccagcaattaaatatgatattaaatgagcgaatgacgcttgtgctaagcgtgggtctaaaaaagaacgaaaatgagagacgatattggcgaagtttgtcgactgggtgttggatggcgagcatcaaacagagccaggacatggtcccttttaacttcgaacatgtacagatgaaatattccctgctcaagttgtgatatcaacagacctgaaagtagaaaagaatgtcagccacttggatacaggaattcgcgattaatccaatggtgggagcccaaaaccatcgtgaagcagtcgacttaactgaagtcaggcaattcacatcgttgtagttcaagggatcggcgcagggggaacattccagaggtatcaaccccgaaagaccaattagaacagtcggtaactgtacccgagctatagggctcgctcggaatacctcaaaggttcaaagggttggcaaatcaagcaaggagctacatctggctgcttagaaagatatactcaggttagaacaatagttccctatagtgtatcgctcgggagacttccctgattttcaaatgggttaaatggcactacgaaagatttcataataacccatgatgtatcagtatctatgcttggatactaaacatacccatagtatgtggatatatagatcgcacgcgcgggttaagctgaacgtttccacctttgcttcggagttcctatgtatgaagaatttcttagcttccaatcgttggtctatcgtactaccaaagcctgtatctctcgtttgttgcattggtcttcacgaggcgttaaaacatgtggaagagatctagaatcggaagagccgactacatacattcctgctcgcgcattccaccagacagttgcctaacaagttaccattgatccaattcccatgttaattgtaccacgtcaaataaaccgagaccaaagttcaacacagaagctcgttgttgactacgcaggaagctccatagagaactcatgaggaggggagagaaggggacgcaccgtagcatgttcatcttcgtgagaataagctgctgagatactgatctgggcgcataactggaacttagtctaaagatacaacaggatcataatggtgaacaggtcaacgtaaccaatgctaaaaaaaggtcttccacgaagtgctagataggaaggtgttgaagactgaaaatgtcgaggtgatcttgaggctaggtggttttggggctacatgctaccagagagatggtgatgaatctatggaaggaggctgagcctctgggaatgacaaacgagacaaacgagacaaactaagcaaatgctcaggtgtaaaatggatgtatactcttgcgctaactctaaatgggttagcgcaagacctgctttatttaggtaggcggtgaagttaaaatgccccgcacggaccctctgtttcgactgggtagatcgcatcctccgatctctttctcttttgttatatcaccttctacaggaatcattgctttcattgcccagtatgtctgcctcacccgaagcatcggcatctgctccagcagagcgcgccagcgcctcaccaatccctgcttcgtcgggccttgatacggaagccaagagtgatatcgacagccagaaagaccaggtggaaaataacgaagagccccaaccgactgaagaaccggagacccattcatccaagtcgcaagccgatgaacctgagcaagatgaagagacatctgcaccaccactccccgatgaagtcccaccgccacttcccgccgaggctccgcctgcaaaggtcgaggacgatggatgggaacctgcatgggacgccaccgcaggggcatattacttttacaaccgcttcactggagtttcacagtgggaaaacccccgcgtgccgcaggccccagcagtcccagcagcaccgggcacagaagacagcacccaaagcgcagttcccaaaaaagcgccagtacttggtggctacaatccggcgattcatggagattatgaccccactgcaccgtatgcgcaataccacgaagagccagaacagcccgcgaacgcagccgttttcgacccctccgcagcatatgcagctaccggcacatttaatcgtttcactggacgatggcaagctgcaacaattactccggaaaaccacaacgatgagaacaagtctcgacgacagatgaatgctttcttcgacgttgatgccgcggcaaacagccatgacggccggagcttgcgcgcagagcgcagtgctaggaagttgacaaagcaagagttgaagcagttcaaggagaagcgtcgcgagaagaaagaggagaaacggcgggcttggctcagggattaggggtctgtggctatttgtttgagttctggagggagggggggttgtttgatgtattctctcgttcccacgggtcgcattgccatttcggagctttttgataccatcccactggatgtgggactcggcgtttgagcttatttgattgtttttctcggcgttctgccttgcatgtggatagaggcagactccctgtcttctctatccacgattgagcaaaattattgtacaatgtagcaatgtatcatcacaggtattgtctcaaaatgagaccatcttagtaatttgaatccatacatctgcccgtagtgattagcaccgacgttcacttgacgacttgtatttgtaccgttccaagactgatagcccactatcagtcacatgacccgcgatatcaaattattttttgctgcgatcgcttcatttgctgccgggatactctacgctaggaagcaaagaactgaaagtaaaggtatgaatgaacttacttcctgttaattgattccaaatttgtggaaaaacatctggaacaccgattcccattttgtggctggaccttgttccttgacgttgaaacgcttatcaacgacataattgcatgaatatatcgcgagagatgctgtcgaactatgcaaaaaccccaatttctccagtcctttgtgattttacacctatcatatccttttttttcttattactcgtcttgtcatcttgcaatcctgaataccgacctattactgacaccccactccagcttaataaataaagtgggatatcaaaaccaaccccaccaaaagaagacaaaaataatatcaaaccctggtgaccatacatcatgtccgcttccacgacatcacaggcaaagccttcagtgccaatcgcactctctgctgatgcagtcgacgatctgatctatgacgcccgagcaggcgacctcgaggccctaaacgaggacatcgccaacctggccagccaacacaactgcaacgagtcccagatcgtggcatctgccattgacatggcagatgaaagcgaaggcggctcgggatcctgtgttctgcacttccccgccgcgaatggaaactccggtatgtcaagaaagatttgacatgacttggttgtttttctacatttcatgtcatgtcaaatatttctgtttttcctctttatttatctttatccccacctctttattgtgtgcattactaacaccgcccagaaatcctcaaaactctcctccaaaagctgtcgtccgcagacgctgcccagcgcgtcgcgttcgtcaaccaccgcaacaactccggcaacacgcccttgcactgggctgcgcttaacgcgcacctggaatgcgtcaaggcgcttgtcgaagctggtgcagaccttgaggttaagaacgatgctggccacgatgccgtcttcctggctgagcggacggcgtggactgctggccagggtgacgatgctgagggtgctcagggggatgacgctcagacccaggagattgagatgactattggtgagaatgagggtgaggataagcctgctgagagtgctggtgagatgtctgcgggcagacaggttgttgagtggctcctggcttcggataacgccgctagtttggagaagggggctactgagggtgaggctagtggatctgcttgatttataccgagatgggatgacagcgcttttttgcagaaaggattgaagaaaagtttaagatttcacgcatagaattggaaatacgggtactttcttttcttgcatatgttgtttgttagtgtctatattaatgcatttgattctattcatcctaagattacattggaagaccccgcaggccccggaatgctgctctagtacatatacataatgttcgtatgttctcatctacacatcaattcaatcactgcggaccttgcccgctaccgctccggtagaagacgaaacctccacaggtggtggagtagaagggccgatctcccgaactttcgcatcgaagccgaccttaaagcgccggtcccgccagacgacagtcacaccgccatacaccgccatgatccagatgggcagggccagcagttcgcggcccagccaggcggcaaaccactgcatgaacgggcgacgggtagcctgggatgatcggtagcgttggggccgagcaaaagccggagtatcctcgtccaattcgacgcattttccggaatgcagcttgatatacagtgtccaatcgaccaggatccagaacaccatgccaagtgcgaacaagccaaagaatgcaccccacgttccaaggtgggaggcaaattgcatgccattccgctcgagatacggcgccagagcagtggtaatgccccaggcaccatagagtgtgcataggaatgactcggtgcctggttcgacaagtgtagcgagtagaacggtaaatttgcggactcgcagccatcggatacgacgggcaatgtaggccggcacgctcatgttggcgacaggctggatagccatgtcaccaaagaccatggcgtgcttgccccaacgctcgcggagctctttctcttcccgcacctgcttcttccacagcagatcaccgatcagatggtcctcgcagatgttgtcggagaagaaatcgatgccgggattgcgagtctgcggttcagaggccgacggacgggtgagatagtcaagatgggagcggcggaacatgttggattttcccacgatgcacggcgcaacgagaaccgtgttgatcgcggtgtacattttggcgtgcgcggaggacaggaacagctcttccaagcgaccgcctccagtcgcgatcatggctgcaggcccatcctccggacggacggatggcatcgctgcagccgctgcattagcacccgtgccttccgggttggcatctaggagcgcctgccgctcttcacgaaggttgctatctccggtcacatccactgccacaggcagatggtgcacgaacttgtatttcttgctcgatgagggtccagtcccgcacagcctgtccaccatccgggcacagactccctttccgacccagacattgcagtcaatgatccagacaatatctcctttcgcttcacggtatgcgcggctcatattccggatcttgggattcggtccgagcgtgtacgtattgttgccatcttgctgcaagagcggatcttcctgttcgacgaaaatgcacgcgtcgacatgggggaaatcggtgattagtttgcaaagggtagagtaggccggatcggcgcgcgtcgctacacagagccgaatgctgagcttgtcgggtgggtagtcctgtcgaaaggtggcagcgaggcagtcatagaggtgcggctcgaggcccttgacaggccggatggcggtgacgtgcggtacgtcggagacggaggctttcgttagccgtgaccgatgtggcttgctgaggaaatatttccatctgagcagaaggaattgaattagcggtatgccattttgagaaagtaggccgaatcatacatctgaaaatatcccaggccacaaactcccagtatgaatgtataccagatcagggcaatccaaccgatcgcgacggacacgtatagcgagccatcgtcagacctgcgaaggaggaacgaaaaggtaggctttagcatgggacacaaaggaaaagcaacatagaagcagatgagaatgacattctgagggagaaggagaagcagcaattggatgtgggtggatttcatttcggcagttggctgtctccgccctcacaagctacaagacttgcattggaccaaccagagggcatctcttttccgacactataaataatgcgatgtatcgaagtagctgcctactcggaacctccggatgtaaaggaaagtacttatgtagttcaattgtagtaattatggctatttgtttattgtcgaatgaaggaaaatgatcaatatggcccccaaactccacctctcccatatacctaaagcaaatgcaaaccgccgttaatcacgttttcttcttcttccggaccaagctcgcattgagcacattgactcctgccggctctgacggagctggttgcgcgtctcccgatccactcggtgcttgggtttcattcgcaacaggcgtgccctcacccaatgacttcttccgcttgcggatcagcccgaggtcaaggacattgttggtattggtatcggcaggctgggaagcagtgctgcttgtggtattgctgccgacaaccttcttgccccatgtaagctcatccgcgagtgaagaaactaggtcaacgtagagcttggtactggcaacaacttctttctcgtcatagaaatgatctaaaactgaatccatcatctttttgtagtctgcttcactgagaacgacctgtccgcgtccggcctctggccagtcgaaagggttgactgtactagatctaccatccaggggaagcttaggagaggtatcggcggtcgtggaaattgttgttgccttcgtcaaggtggcattttctttggtctggctagagccattctccactttctgctcgttcggaatggccgcagaaacctctactcccttcgaggccaggccgttgtcagaggagccgcgtgtttggctttccattgacgttgagttcatcagaccaggagggttgatgaccaaccacagaaagccgactaaccgaccagcagagcattcctggcggaaggacatcatctcccagaattggtccaaggaccgtacgctgcgccagcgtccggcattaggagcgtcaggctgggcttcattctcctcgggaagttcaccgtctaggtcgatgagaaaacgagtcttgggatcatcggggaaacgaggcactaaacagcggggaggagccgagggatcgtggtacaattgcttcagtgggtagctgctgagccaccgtgggcgatcctgcgcgtcggtcttggccgtaggcgggaagaaattgcgtgtttcaaagcggtcgcagcttggaacaatcaagtatgcggtggcagaggccttggcagcttcaactgtttgatccagcgctttcgtctcctgaagagcagactctggctcatgctcgcgtaaaatcgggtctagaacacggcaccaccattttattagacctcggtcgtccagaacgtgtttttcggcgttctcaatgctacccgggaacaggtactgattctgggcgcgggcgaacagcgacacgaccagacgtacaccgggccgttggcgagttcgagccagaaatgagagaaatgtattggataccagtctcaggacagataccctgcgtggcagttttaggagatgcaggagtccagttgagtcggccttggagacgaagatggttgtcaagtgggccgcgttgtagactagtacctccattccgaagataattgtctcaccatcatcgttgcggtcaattgacacggagaggaaatgattttcgcagaatgtcggttcggagacctggcccggcgcagctgcaaagagagcctcgcacggagtgggtgttgaggagacatggcgaacggtgatctcaaccccggtggggaggaccttggccaagagatctgccagatctgcctccattctcgttcgtccaatgagagtcgtggaaaaggtgaagagaggagctggagatcgcggtgctcgatttcgcgccctcggagatcacgtgccaggaacatatactgccgtttcaggaaggtcgatctgtaagacattcagaaagtctttgggcgggttaattaagtaggtggtagtgaagcagtgaaaggtgtcagcaacgggattagtccaaatacttcaaaggatatgtagaactacctgaatgaaagaagatgggaaaggcttattcatagagaccgcgctgcctagcatgtttgctcgatactaacgttagccacctgatatgtgatatttcgaagtgttggacctctgtcatcccaccacttccctcagattctccggttttcccactctcaaacaccaacccatcactcaacccagactctgctactagtggatagcagaacaaaagataccaccaaggtaagtaggctaatcagattgatatttcattgagcagactaattgtactaacatttcatcaaacatggaaagcacagcttcaagtgtaacagagccgcatcctggtcacgccgatcaagatgtctcacagaacctccggagacctcataggtaagactgaatttgtgttaactctgtgcagaaacgccactgaccctgcacctcagtgcccgacctcaacaaccaggaggtctgcatccagttgcagatccgttacacctgtggtcactcagcaggaggcgagttcatcaagtgtcaacgacacatgaaaaaggaggatgaacgctgcattggtcgccaaatcaagcacatcgatgtcaagaactcgccacacaagtgtcgcgtatgtctgcgaagcgaatgagacacggtatggtatctattcggcaggagctgacagaaggatttaccttgggagtctggggaagggcgaagacggcgcattaagacacatacgattatcacgacagagaagccggtgctttctatctttgttctatctttgaatcaaggaagttcctggaaggaattcaaccagggttattaacttacatcccagtaaaaagccacgggggaataaatgtaatcgaatgcataagtgactgtatgatattgatatcatttcccgggcttgatgttgcttaaaagtaagacgccacagcatccagatcatccacattgagcagaatgaccccttccctcaaaagagccctccagacaaggtttcgtgtacgaactgggaagtacggcgtgttccaatatctagcaccaatcccgcgctcatttgcagtggcaatctgggctcggagagcttttacttggtcgtctgagaggatcgggtccgtatcgacagttatcttgccgacggcttcctggaaatccgttgaagcaataggcgagacagtgctagtcacaccagcgtatttgggatcactgagatccgcgagaggcgcatcgaaaaagtagtctcggtctttgacgggcgcaaccatgtcgaacggtgtctcgcccgtgccgatgacagtgacgggtccattggtaacgttgttgccatccttgacggtagtaagatatcccttctctcgtagaggttctagagcatcaatcacagcctcgaacgtctccgggccggatgtcttcacatcaatgaagaagtaaagcgtttggtccggaacagtatcccacacgccactatttcgacaaagcattagcagtgagaccgtgttgggcctcgaccagatactgactttttagtgggcgatgaaataaatgcactatcgggattctgacgctctaggacatccagaatgggattgatatacaaggattcgagagttcgtgactccgtcagggcggattcatcgtgaccaaccttgtatagttagtatgctacccacaagaacgtgcaagatatgacaggttaatcaaacacacataaagggtgccgttgtatagccagacatcagcttcggtagacatgcagccatgcgagagacctgagcatggtcatgtcaggggaagtagacactagacactagagctccgacataccggtatagaaaggcttgtcacgccaatagtcactgggaagatcagtatataatcaataggagtgagatgggaattatccgtacttgtgagaatgaacaggaatctaaacattcgtggcccttagaattaacaacattgtccagatggcgaggagcttcacagtgtccatcgatgtacggagtataatatcatgcatagaactcacaggtaagagatctcttgtcagatcagtgggataaccatattctttgctgccgtgggtgtttttcaagatgctctgtagggtagaggggatcgccgcaacggctggatccggacccgcgacgagagccacaacaatggcagagaggaacaacatgaaggcagagagcattacctgatgaagttactcaaagaattggccctcgtttatatatcggggaattgaaagaaggtggaattcaattgaattgaagagggaaattgcactgacgatcggcagattcacgcacgtgtttccccaaggcgttctaaggggtcagtaatcaccataacgccaggggggaaaaatatacgagtgcaatatataagaaacaaagttgatcatttaatcttgcctactagaaacaaaacagcactcaagcaaggtgcaagaccaattaagagctgatcgtacttattgtttattagacagactacaagaaacagaggataataatgtatggtatttggcatcaatgccagaaggtgctaaaagaacatgaaaatcgccagactaacatagtcatcaagggagctcgaggaccgacgacggcaagattgtccaagaagaggccagttgtgaaatgaaatctatgtacgtcacgataatatgaccttaaacctcccgcacgcttggcgaagaggcagcaccggagtcttgtgagttccgaccccgaagactgaggtttccgatgcgctggactaagttgctgcccacagcatcaaccgcacccttgggcgcaagcaaggtcgggccttgagcagcagcttcttggactctgaagagtttgatagctgtaccgttccagacaccaacagttcctggagttgcaccagaagcggaaccgactaccatctcgctggagaagatgaaaccccacagcagcgattcgtaccagcccatggaaagtgcagaccactcgaaggattgcacgcgaaccggggtgggctcggagattatacttttaacctcgggctcgtcagcaaatgatgggagattgtggactagtgttcgggcctccgggctggcagcgcttgcaagcgctgcaccaggtatatgaggtgcaattgctgagatgatggtgagagttgtgtgtaaaggaagctcgggcaaccatgactcgagctgggaaatattgttagtagcgaacatttaatggaaaggtggtttggtctgcaacgaaacttacccatgggacggttggagtgaagccactagcagagggggtgaataaagcagacatgctcgtctgactggtcatgctgttttgtcgggagaaaggtggatgtccagcgggtttctttccccgcgccttttcggacattgctcgcacctgctgcactccgttctcgtccatggtggatgtcgtggagggcctccgtgaggtttgagctgagaatgatgactgagatggcgtctgtgttccctcttcctcacgttcatcatcggagtcgtcatcgccaattgcaaatggactgttctcttcggggattcgagtcaatggtgaccgggcacccgaaggagtgtgcagatcatcctctgactgtgaaagtgtagggctggtggcgacatctgaagaactgccagctttcctcctctcattctgccgttcgatctcttgctgaccactctcgagagtgaaggcccgcacagcttcaaagcgttgcctatatttcagtatcgagtagacgagatatgggttgtctatatcaagtcagaaacggctgggcggaaagttaagatccgggtagggagtttaccagtgaacttgtgctcgagcataatgttgatgaagtcaagcaatgatgcaagaagagtatggttggattcgttcgccaacaagaaactgggcgaagacatagaagtaaaaagttggatcaccttcgagcaggcacttggagaaatgcgttcgatatagggagcaatgttgttgaggatgatcaaaagcgcaggatacacagtatcgagattccccttgctagttgtcatcaacgtgtgaattgactgcggtggttagtatggaattatgccctcagatgggggcaaaagacaaaccgtgatcaaatagtcgccataagacccacggaacttgggtagccgaatcgattgtggtaaggtctcttgagcttcgaagctgttgtttaggctcttggcaaatgttggctccgcactcattgtctgaaggatgaaaacgcacatccggacgactccttgtttggaagcatccattctatactccattgcatagaagatacatagcacaaggaagtcgtgagagcgattagagtcgatgataaatgaccggaaccttttgttgcattgcaaggtctcccagaaaaggaccaacatctcaggggcccatttcaccgatctttgactcccagggagataagaagcagtagcttgcatctggtttagtcaattagccgaatatcttaatatatcatttagcagacaatacttaccggctgattcaggattctcgtcatcccatccaccaggaattggaagtcttgaggtctgtgtagcctgccaaagtagtggcgataataattcttcggtggagatccacgaccgtcttctggaatgggatacatcaagaggacaaggagaagttgcacgcaatagatcaccaatatctgcttgggatctttccaaacaacatggtcgtatgggactctccaagacgcagggttatacttcattgcctgctttgaattagcatggctcccaccgcctagtaagtataacgtactgtattgagaagagagcaaaggagagtcaagacagcctgcttatcttgacacgtcgtaatgtaagtaattgccttgacgccttggacgggcaatgtatctataccagtcagtaattgttggaataccttcataggactcgagactcactagacggcaaatacatggcctttccagtcagagtaagcataagacgtagaatctcgcatcggttgctctcgaatgttttgttggaccccatagctgtgttgcagccaacaccactctgccaaattgaaaaagagaccttgctcttcactgttggaagtcgagggattgtgaagtcggcaaagaagagcaggtccaccagtgtatctatcaactcctcggcaagaggcttcacatcttcgtaatcctctgcgcgcggtgacgtcgcctcttggttatcctccggctgtgcttcatcaaagaggacctccccagcaatttgggactgcctggttcttctctttcgacgggcccagaagaaattatcctcccattgctccagatgttccgcctcgtaaacatatggaaggaggcgggtgaggatccgaatgcaattgaggacatcacgctcgggggccagatcggggtcgggaaacgagggatgatttttcaataccgttagtcgcgacgtgactgcgagtaggagtgtttggaagttgtgcaaggcatgatctcgcgtgcgtcgtatgtcggccggtgtgaaaaggctaaagacatcttcggttgattcaggaagctcccagaactgccagcatggttagattccgagtctattggacaaatagtcattttgtatcagaacgtactctggtccagtacgggtcgtctgcggggatctcctgttcctccgagagccggaagatgccctgtttgaagacaagcttggactccgaagctcccatagcggaaggaagctggtaatcacgccgttgtgggcttcatgcagattttcacagcaaacgtcaatgtgttggtgaggtgagggcgctttctgcctgattatttgctgagtgctagaagtggttggtggtcctaattgtccgggcgcgggatcttggcttgaacacggggtatggcagatcggccgattgccaccagtacgacttacagggactactccgtatacatgtgagatgagatcgaatggtagctagtctcgtatatatcccttgtctaactttttaccatttagtcgcatgcatcaaaagacacttttagcatccatacctactacgtaggtcggaaaagatatccaggagcgctccaatttttataaacacaaatatgtctaatgagaccagcgtctaataataaaccttgaattggtatccctgtaatacattgtgaatgaatgaaccgctatgacattaaacaccaaaaccatgaatgacccaagcgcctgctcgcgagactgcagaatgctgcaaaagaattcagggagctcctccactggcagaaagccgccggctcctctcatatagccacttgttcttgactcctaggcttccacgttttcccacaagcggagaaggcgtacttggggccatgctcatggttgactccccaaaggagttacttcgagccagaggggatgcggatccaaagctctggcgctgaacagactccctgcccccgtttgacactgctttgtaaagcaaaggactggaggcaggtgagaagggtgtactgatagaagagcgtcgctcagaaaagcttgcatttgcggacataggggaggactgtctgcttgcaggactggccttgcgtgatgtggaaagccgatatctgggtggggtaacgaatgttgtcccaggagttgctggtggtgtgacagcaggatccaagccaaggagtgagcgttgggtgggggtaaggggaatgtcggagaggtcgtcctttggccggaagaggggatagagcgccactagaatgttgaaaacaaagaagagttggagaatgaacaacggaacttcttgatacatatggttggtatcaaagatttggcgtgagcttaaatggggctgttagcacgcgacgcgacgcacccgagttcttatcgcactcactaggttttgagagtagatccaaacgaccagctcagtatcaaagctgcaccgttccaaaccagcttcttcacatttttctgatcaaatgtagctgcattttggcgccggacgatctcatccagctgagggtgtcgccatttcccaggggtcagggtaccctctggggtgggaggagccagcggaggagtcgctttcggggtggaagggagagattgagtcgccattgctaaagcggtgaagatgtgatgttgtcgagaatggatgttgagatgggattgactcgagactgcaatcgtgaagtcagccaccgatttgtatatgctcaggctgctttttttttcccgagatctttttgacaacagggaatggacttgctggtattatgacttgttcagtacttacctggaggaaacaaacacaaggagctgtaagttagtaaatgcacatagctacctaggtatgaacaactgttctttctggaattcgttagtattgttgttggctatacgttgacgatcctcaagtggctgcgctcgaggaaggggctgcgcgggcataagttgacccggccaagctgacacaccccttatcgccgtgccccctcaacgtcatagtcgctgattgttgacacttcttcatccccagattgaccaactaaaatggctgccgatacttcacttgtggagaagcttgatgctttggtggctgacgttcttgccgactggaatatctacactaccgttgtcgccgggattgtcctcgcttttgcggtttactctgtcatttcgtcccgggatccagatatccatccgttcctgctcgctcgccaatcgacagcagccccaatccgccagcagggtgagtctgctacttacagatgcttggaaaccccacatggcttgcctctccgcttcggactgaacgtcaaggacccgggcgccccgaaatggactggcggtcgaagaggagacctgcgcgatatttggaagaccgctgtgcgtggagctctgaatgaggatggtactctttcgggcaagcaaggcaaaatctacactgtcctgggtcgaaaggccatcgagcactctttcggccaggtgacacaggaaatcaatgtcattggccatcatctccaaaacgctggcgcgaagacggtggctgtttgccttacagactcaatcgagcttttagctacaatctttggtaagttccttatcattccatgtgtgagtctcgatgtctaaccttgcgcaatctagctggcgctttttatgggtataaaacagtcattgtgccacacaaccttccagcagagacattatcagcccatcttcaaaaggcaaaagcggatgttcttattgctgaagccggatctctcgacctgcctctcatcgtaaagggtaacgctcaattgtcgctcgtcctttgggtcgccaagtatggcaatagacacatggattggaacgcacttcccgagaatgtcaaggatagtttgaaggttgcagtttggcacgaactggtcgaggagttcaaggaactcgccagctatgatgtgcccgagtacgacccaaagacagaaacccctgctgtcaacaccgtttggccgtcttcctcacaatccggccaatttattgatttccagccagaggtaagggtgacccaactcttgtgatattactttgattaacatccaactagaacttggtgtctgccattggagccataacctccactatccctcgcacccagcgcttcaacccaaccgatattgttctttctattgactctctttctcggtcctacccgctctgcacaactatggctgcactgtttgctaactcgtctatcgcccttaactctgtcgctggagagaatgttgattttgccctggccacggctggtgtgtctcccacagtcattgttgcctcgtcgcagaccatggccgaataccacgacaatatcatgcgcccgcacactggtatcatttcctctcttggacgctggcttcaggcacggactttggatgcaggaaacatgccgacgcgcaattctttcagccaattggctcgtttcagtccgacttctgagctttctctagatgaattgcgcctgctttgcatttcccaccgaattgatggcaaccctgccgcccatcttacctctgagcaattgaccgagcttagaatcttcactggggctcgggttgtgtatgccctgactggtcctggtgttgctggtgcaattgcccaaacaaatgcctttgactacagatgcctcaccggccctagccactttggcgctccgctgagtagcactgagatcactctgatcaatgtccccgaagattctcctgatggaacggaagagggacaggtatgtcaggctcaattccaccgctctcatacataactaacattaactttcttagctcaccgtctctggccctgctgttgtcggcggcaccaccactcttaccggccgagtccgcatcagcaaggacaataccttggagttgtgtccctgagcgtgtcgatcacgaagtgaccatttgaaatagcatttcttttctttaagagcgtacttgaaacttgaactgccaggacgttttgtatgtaactgaccgaactattgcgtgtatatgaatagcacctagcggggtcagatgtggcatgaaataaaagatctattctctgaaatacatggccagctcaagaatatctgggaagtacagtaatatacatgccgatgtggctcaatcaacaccaaaaggaatcataataaagctcaagcgttttcctcagccttttgttcgggctttggcctgagcaatttcttagccaccttgtccccaagcacattggcgttcttgaccttctgcaactgcgagatcaagacatctctaagctcgttacagcgagtcttgaaactcccagtgtcttgtgctgccttgggcaacccaacggccaaacgcatgccgttgtagatggcaaggttctcctcgagtctctcaatagtctcaaagctagtagccgcatcgtccttgaaatttcctcgtgaccaggctgcgtcaagcttctgagcgtagccacggaccaagtcaatgtcggcctcattcatttgcgcacatacagcactgagttccaaaagcgtgccaataacaaaaggttggtgtttggggtcatcctggatgtcctcaacggagtgctcgggagcatccatcaggctagctgcctccctggccaatctcagagccttgacagcggggttccccgcggaattgggtttcgcggctgtcctgtgaagctcgaagaacagacggcgagcgatgttcttgttgccgaggctcaggccggtgcgttgggactgtctggcgcactcgataatggttgaaagcttgccggcgtcgctggttttgcgaatgatgtactcccaccggtcgctgttgatggcgtagtttgacatccggagtgcactgaggtacgggaaaaggttgctgaagttcttggccgcgaccatcatcttgagaacctcgagcgcgtctttcttcgatggcagatcgtggcgcgtcttgggtgttagggtgaactcttcggtctcgctgatcttcacggtaatgggctcattttgcaattgtgtggcgtatttctccctgaacacactctttctctgtcgcttggggagagcaagaggtatgaacagctcattgcggaaacgctccagagcttcgtctaactcgggggaggatgttgaggtgaaggttgggattgctgttccggtcgcctccgatgagaatttgatacccattatggatagattaatgcatacctgcgtttgaaccatagctgcgggcttgcatcggtctcagaatagactggcgcaccgggctggtggtgctctggcggaagagcctgctcatggcgaattgcgccatcatgtgtgatcagaggctatgtatgaagcgatgcagggtatgggagtagtggccgatagactctccccaaagcaaaaacaagaaaacgagactgattggtatcctagggttggacgagaaaaaagattcgctgttatctgcaacccgaacgggtaactggaggcttggcggaaattctgccgatccggccaaaactcgactccgactttcttgacttgacatcctcatcacaaccatggcggctctaccagcaatgcgcccgctgggctgcttgaggtccttggtgagggcttcagagcctattcaaccctttgtcaaccgtcgattcatttcgacggcctattcaaagagacccgaacgggtacctcttcccccgaacatgcctgagcaattcctatcccaaatacctcttcgctttcgcccggatcctggtatgtcctttcagttgagaaaaacagacgcgagatttactaatcctcgctatctcatgtagaccgcgagcccctcaagatctaccctgctccgccatccgctcgcaaagcatgcaaagatcccgtcggagcggttaccgaatcgcaattggcagtcctcgaccccacgggtgaacgcaaggccatgttcgactaccgacggaacccgcgcagtgtcaagaccggcgacatcgtacgagttacattcaagaacggcgacccattcaacggaattgtgatgagcatcaagttacgcggaattgaaacgtcgttcctcatgcggaacgaactcactcgtgttgctgttgaaatgtcggtcaaggtcttcagtcccaacgtgaacagcgtggagattgtccagcgatcggagaagaagcgcagaagggcgagattgtacttcttgagagacaagaagcacgaccgccgcagcgtggagaacattgttgccagctatgttcgccagaagaaggctttcttgggtggcggcaaccgtcggcggtgattgagttagagggcgtctggagtgaccctcatttgcatacgtgtggctgtattactacctatcattttgtacttcatctgtgtttataaactgcgatatcaaatacaattttgagctgttctattctagcgcccatgccatcttgtaccatgtttctgtagccaaggtaggaaggtctcacctggtagagggaatcaagtatatacctaggtacgtatcggataacgcccgcaagcatatagacatttttaacggaaggcaagcgctctataaataggaacagtctctataaataggaacagtctcagtaccaaagcaagtctattcctaacgatataatgctctacgaccgctatatctgttcagaaagattaaggcaccgactttgactagttatatagtgaaatgtcggctagattatcggcccgagctgaccgaacctgagcctacctaggtactccccttgccagtccagccaccttatggcccccgacttgcaccccccagcttaacatttgctggaaccactaaccatcaagtcaaacaaaccggtacatgtactgatactctcatgtcttctgtttgtttctggggtgacaaacagcggcaagttctgagccgggacgtcaaccacaacctcatcccatcgacccgtcaacagtatttacaaagaccagatagatgagtcgatttagttgaattaattagtggcgttttggttgagctaatgattaatacatttcaaagtgtcaaggaatggcctgcatggtacctaggtagtgtttgacctagcttgggaagcgactgcgaggagagtttccccgcgttgaggctggggtgactttgcggggtacccctgttgtggggtgcatgcgtcaagtatagggtcatctatatggccatctagagacaattgccgcacagacatggtcctatgcccacttgtactatccaatcattacttaagggaactaattctgttgaagtgcggatatcttttacatctcaatcccacggtaaatggtaggtttggtccgcggcaagatggaagccgtcgccgtgagcgtaagtctctcttcttaccaaaaaaccatatttgactacaggactaactttttgatgagctcttggcactgtctgagggatgcggagggtttgtcatataatactgtctgtccgctcaactttctgtggaagttaagaaggttcaaggcagctctacaacatctacctcaacaatactagcataatgactgaactctcgacacccaaggccatatctgatcatattgactatgtcaacgaggtggacccctcgatcatccaggcctcttttgacaccttgcgaggtctaaacagagaggacctagatgcattagagaagggcttgttgcgtaagattgattggcgtatgatgcccaccatcaccgtcatgtttctcatgaggtaggtttatgctgttgcaaggaagccaaatttcgcactgacttgattcagctacctcgaccgcatcaacgtatccaatgcaaggctggccggcctgcaggaggaccttgagatgtcggacaccgtgtggaatacaggcatatcgatgttttatgttggttatctcatcggccagcttcctgggaacctatggctggccaaatctaaccctcggactgggctttccttcatgatgttggcatggagcatctgcacgatatgtatgcccgccatgaaaaggtaaaactgcttaggttaaactcaccggaaacttgagctgacgatctccagtggggtgggattctgcgtctgccggttctttgtggggttgaccgaggccccctttttccctggaatcgctctccgtaagatattctcattctctaatatacccctacttactattggcagtgacttcctcctggtacaataagaaagaaagccccacgcgaatggccatctggcatgcaggcaataccatctccaatgtcatctcaggtttcctcgccgcaggaattctctacaatatggacggactccttcagctgcacgcctggcaatggttcttccttatcgagggagcagcctccattctggttgccattgttgccttctttcttctccctaattggccccataataccaagtggctcaccgagcaagagagggagatggctcagtatcgaatcatggtttccaatggtgggcacgaagagactcagggaggcacgtgggatggagtcaaagccgccgttaaagagcccttcacgtggttattttgcggtcttcacttctctctcgtgaacgcccaaagcttcaaggactttttcccctcggtatgactgttccactttaagatgcagtggattgctaagcgctaatccaatgtgacacagattcttgcaacgttcggattctctgagctgaccacttacctggtccaggcccctccatatatcatcgcgtacctatcagctctcgcaattgcgtactcgtctggcaagtaccaagaatcgtgctatcacattatcgtgcccattgtcctgggtgcagggggagcggcgatgcttatatcgaccctcaatgagggtgcgcgctattttggcatgatcctcttaattagtgggacttattcgggcctcaatcttcagctttcgtgggagacaacgcttgtgccctctccacggagcaaaaaagcggcgttgattgccattgctaattgtctcagccaaaccagtcattggttcagcccgtatttctttcccacatcacaggagccgttctatcgcatgggaggtggtttgattctattcgggtgtatatgcactgtggtgttgtgttgggcaatcaaatatcgggctaaggtcctgaatcgaagattagatgccacagagggatggtccagagattgcggagtcgaacggggctggcggtacatgtattagacgggcgtgctagaagaaacacaagctgcaatcttgcgtatcaagggtgaaacagttatattcgtattgaaatatatcatcttgatcctgttttcggggattagatttagcaacaccaatgaaatacgcctcacccaacgcaaaacatgtcaattaataagaccttccttcttcaatcatccaacatgccaccagtctacctctagagcaagagggggaaatctaattgattacatataggagaactaaaggtgcatcactttgtcaatttagcagtgaatacgccacaccgtggagaagaggtgatcaagtacgaagggtggcatactggttactagttaactacatagttagttagtatactgttaggggttttagatgcgaagtttcctaccggcagcaactatgcggtcctaggcttttcgatgtactagggtttgaatattgtaggaaaaactacagccaattttaccactagaccataacaaaaacctcggttcctatttagggcctttgggggccatatcgaagcttgagaaaccttaatgaaacatgatcgtacatagacacgagaattgttaaggcgtatcaactggtctgattgaggttataggtaaccaagctgagcgaataagtcaaattcggtctgggggacatccatacttttcctttttttttgtgaaatcgtactacggtcaatttacatcaaaatgtctccgtgtcccgcttaatatccaaatatccggggaaatgtttcctcagaaaaagctgccacggcactgataacgctttggatatttgccgccatggagtcttcgtcccacgggatatcacctcccgcggagcggagatccacccaactcgtagtttgtgagcaaatgccgacagtggaaacttgtagtttgaaactgacttgaaatattacatataatcatggtcgaggccttgagctttgcgtcatgaatcatcaatgcgagccaccttgtgctcaagaattatcatgtctacagcagcaacagtatcgatcgcggaaacttgcgcggtttccaatcactttcccttgagacaatatgctccatatccgacaagaaggtcattgcccgcagtctggatgcgctcaggaacatcaaaggggcttttcatccatcgaagagatttgcccgagcgcatcgaacagtgggggcctattctattatcagcaatgggatcatccaatgctggtggccgacagctcgatgggattggaggcgccacttcaactacttcgaaagtagcagtcgttgcgaagtcagctcgaccgggcatcgatgtggactatacgtttgtccaggttgcccctgatcaagcaaaagtcgatatgactggaaactgtgggaatatagcatctggagtgggtcctttttcattggacgaaggtcttttgagggtggaggcaggtcaaagcgaggtgaggaaggtgctagatattcatgtttatctcagagttgactggacatcagatcgacgtcaggattttcaacacaaacactcagcaaacgatctcggaaaccatccagctgtcgccggagggcaggcatagagacgatggagattgcagcattcccggtgttgagggcacatcaagtcccatcaaggtcgcatttctcgatcctgagggtagtatgaccgggaagatgcttccaagcggtgcaacacaggagactttcactgttcattcaaagacactggggaccatccaattgcgagtcagtctcgttgatgctggcaacccatttgtactagtcgattctaggtcgttgagggtgaagggctacccaacgtggccagctgcagcggaccctgatttcatgttgcttgctgaagacattcggcgagaaggtgcggtgcgatttggattggcctcggacgtgaaaagtgcgagcgtggttcgaggcacaccgaagattgcatttttatccccgcctgcagatataagttcagacatagatgtgcttgcctttacaatgggaaagccgcatccgagtatccagattacgggtgccgtatgcatcggggcagcggcggcaattcatggaactgttgcgtggcagttggcccacggatcgacaaccaataatttccccaagcatgggttggaaattgacgggcaaaggattgcgagtccttccccagtacgaattcgacacccagctggtgttacgcagactgaaacaaccttgggtgtaaatggtaaaggggatattcatgtgaggcaggtgggagtgctaaggaccgcacgtcgtttattcgagggaaatgtgttctacaagatatgagcttataaattatcaccaatcgtttagccccaaggcagagcagtggctcagtaggccgctcccatgccgcgcactcaccttctgtccatactccaaggaagaaacacaatccctagcttaagacagtaaaggtgaggcaagaaactcttgcagtctattatcgaagcttggaaaaactgcatgtgatcatagggttctttctcatactggtcggttgagcaagttgagagtgcctagattttgaatatggatagcaagttgcaaagtttccctctcttcttttgattggagggagttgctttctatagcaagtaataaaaaccaattcaattccgagcactagaacgaatcaaaaacctggcaattaccatgccctagtgatatagcagactgtcctgtatagatccattgaagccaaacagcatatcatcatcgatctgttcatctacatatgaaccgtaaccggggacaatgcttggggcaataccactgaccacacctagatgatctgcggggatatcggagggggcattgtaagcccgctcaagagagatatgcccttcatttcgccttgtatcttgtcgaataaagctttgaataaccatatctatgtccaattcagaagtttccgtctccggaggtgtcatttgagcaggcaaagcggatgttccaagagattcagggtcaagatgagactggtttcgaagatctgctatttgttcgtttgcatcatcttgcggttggggatcgctgggtgggcgatcttggctaccgatatctactcccatccggtccatcaaatgcattatcacatttttggcacgccggacagcccagttggtttcttggttctcttggaagacatcaaggcacgtccagagatttgagtgggctctactgccacctcctcgctgggcagcgactcgaacatggatagttgcggcaacgtatgtcgcatatgagatcagatagggcgcacgtctgatggagaatgctttatcgtaggcttgtaggatatttattatgcgagatgcagccgctgtgcatatggcaaaagagctgatcgcaactgactgatcagttgtatggagatgaccttcagcaacgaagggtcggtggagaagaatgagcaggacgttatagagtgccaagagagagaggacatggggtggcggtgtgacttcttttgcagcatttgcaaagcgtaaataatccggcagagcctcataccacccattcaactcaatatccagagctttcaaagtagtgagcaggtcctggggcgagcgatttgagctcctctctgagtaaaccttgttcagaataccgttcaagatcaacgacagtttgcaaagttcagtaaaggttgagacactgtatgcgggcgatcctgggtatgactgcatatccgtatatgcgaacggttgccaatgctctagttcttcataatgatccaaaaacgccaacgagacctgagtgtcaaagtcctgtaaacttgctggacgtccctggtagagcgattggattttgtcgacaacaaaagcaccccagaacactcgacgtcgtatctctatatcttcatccgagagacgtcgcatgttcctgagcatggtagcatctacgtgcatcccaaggtcgatgatcatcctaaatgctgtaccggcatagagccaggcggcactgcgttcatctcccaatgcaaacagggaactagtcattactaacaatgcttgaatagtggtgatttcacttcgatccaaggcaccgcccagcaattctttgactctctggcgaaatgtccatcccgcagtgcggacatcgtcgggatctcggcgaacctccgggcgattactgaattttgacgcaccaaagtaaatcgcattcaggaggagcttagaaaagtaaggaccaccggtggccatatctcgcataaaagccgggcgataggtaatcaagaaggaatgatgctggcggttccagtggagggatagaagatgcattccaagttcaggatcaaccccatcgaagtccagtttaccttgccgcaaattcaatctttctaattgacctgcttgatgttaggccgtgataataacttgtgacaaacgggaactcacgctgataagctgactcccccatcaactgtttgcgaatatgctctaccggcacctgcggatcccgtgaccgagggtgactgtgtctatcagtcggtgcatcgtcaaacaatgtgcttgtaagcccatggtagcttgagtcaccatttggcgagatgaagattcgtgatacagcggactgagatcggttggcacttgatgaattcggaatgtctggacgaggtgggctttgctggcgctgatgggatgggcttggggaatttatttgtccctccgacggtgtattgacacgccctagatgtcgccggagttgttcattttccgcttccaggcgtgatagccgagcatttgttggtctacggctggtcagtgacgaataagtgaaaaggcagatgacgtacctcggtctctcaggtccgggtacgtaggtacatccttgtgaatgtgtcttgcagttggaacatggtcttccgttatcgcaacggaactatctgcattagatcgcggcactaagaacttgagagtttacctaccttcctgcgtcgacagaaggagcaggcctttgcggccctccgcggcttagacggggagtttttctccatgaactttttttttccctgggttcttccgcaagagaacgggaagaggggatgattatacgtcttttcaattgccgcggcaagtctctttccgttgttcgtcctccgcccttctccgcccccacatatcaaaaagtataaagttggggttgtcaacattcaacctctattcgtcgcgctcaacaagggtcatatttgctgcttgctcacattatggcccacattgctcaatcagaaaggtctgcaccacagaagctgcaacgggtaattgctttcatattaccaaaccatcttctgttagctaacctgccagatccataccccaccgtgggtctccctcgtggctggaggaattgcaggtggagttgaagcagccataacagtcagcccaacgatactccatgtttgtatagcgattaatatttggcagtatccatttgagtactcgaaaactcgcgttcagctgttggacaactccgccgttaagaccctcaatccactacgtctcatttttcaagtggcaaagcaggaaggtgttagtgcgctttacacaggctgctcaacccttgttatcgtcagtcatcaatccacatatttgatctcaatctatattgattcaatgtacagggaacaacggcgaaagctgctgtgagatttgtttcctacgatactatccgcaattcccttacggataatcatggagttctatcacctggtaaaggaatcctggctggaatggttgcaggagctgtagaaagtgtcctcgctgtgacaccaacggaaagggtcaaaactgcattgtttgtgttctccgtcattgataactacatctatcaccgctaactaatctgcgtagaatcgatgatgcaaaaggggctcgtgaatttaaatctagcctccatgcgataagggtattggtacagcggcacggtatcactgagctttacagaggtcttttgtccaccgcgatgaaacaatcagccacatcagcagtccgcatggggacgtacaacatgctgaaagaagccactagatccaagggtattaaaacgaacgtattcacgacatttggaaccggcgccatagctggcgtggttactgtttacgctacacagcccttcgacacaatcaagacacgggcccaaggtgttcaaggagctagtatcactgaagcttcgcggagcgtgattcgtgatcacggtattcgcggattttggaaaggcagcagtatgcgacttggccgtctacttttgagtggtggtattgtgttctccgtctatgaagaggtagccgacatgctgtcgccgggtacccataaataaaagtagcggggtacaaattctgtgtagctagataaatttagaactgcatgtaagcatcatataaaaaaggattctgataattatggcgcgcggtaggagggcaaagtagcaagttgcttctataataaaaaatggaatttcagagacaaatgcgggacttaacttgtgctatcgtcttaagaggatagcactggcggataaacaaattgtttggaccttacctactttccaccaaggaggagtgattggtgtttcttttatacatattaactcttagcatcggcagccatagctttggcaaatatgtactgcatttaaacttctaggatctgtttttacactaaacatattctagtgaatattgagatctttaagcatctgtctgatactgtgcctcatagcgttgctaagtatatagcgagttgcgccacactccagttcactcgctagcactataggtgacccaaattctgactataagacgtccttgactttgtatgtcctaaaaagtgcacaatacgtgcttgcgatggtatatttctatgtcttcaattcacgaaattgagagaaccaaaattcctttagcactagacccgttcaatgattccaacgatctataaacttaatgactttcctcgcagtaatgctccgctcaaattcttcaaggtcattcacaaacacaatccgtgcaagatgctcattctcgggaagtataagaaagaagtcctcgattcggcgtctgagattgtcatcagatataacgccatcctgtgaacgtttgagcaagcgaatctccaaagttgattggggcgtggtctccagtttgtccaaaataatttgccactggagaatgcccaattccttcgtgtgcatcaaggcgtcgacattgtcgaactcgaagtacgagccataccacttaaagctgaagcgatggtcacgcccgcgcatacgcaatactcggaggtgttcgcggtccgccttaggaatcacagcagaggccgtatccggtaggggatgaacggaaccaatatcaccggtgttatagcgtattaggggattgcgtagtctttgaagagatgtctgcacgacgaggcccggttcaccaagtgggattgggcttagatcggaaggtgaaacgatctcgatcagcatactgcgcgtgtcaaagacaaaatcggtgctgatgctagtgaggctgtgctctcccgttagatcggggctgctgattgcccagggacccgcttccgaactacccagaaaggaaaggatcttaacgccgctcagaatcgtctggatgaacacccgctgggggctggtaaggggttctgaagtatatattatcttcgccaggttgatacgatcgcgataatcctgaggcaacatcgagatatggtgaacaacttgaacgatttgactgctctcgccggctaagacattgacatggtagtccgcgagagatctagcaacttccgtaggtggcatatagctcccggcgctcaaaacggtcgctccagcattttccatgatctccgtcgtgagatcgagggacctgatcattccttgattaggtgaactgtgtcattttatattggcggtctagattcgattacctgtagaaccccccggctaaatgggtggataccacccaatctcccggctcaatcataccacaaagtttgataaagtttcccatctgggccctctgccgacggttctcatatgcatccacagcaaacaacataggaatccctccagagccgccgccagtgatggacatataagaactttgccgatatgtgttgagggggtccatatcatgggtaagccgctcaatgaccttgtacctgaagcaagttagcacacccgcggtatgaattactcggtatgctgacattatcttacagcgctttcttgtttagcaatggctgttcctggagaacgggtttcgcctcttggtcaattgactcacggagtctccggaccgtgtcggcatcgggaggataatcgacatctggattgtagaacgggtggattttggccacggctagtacttctgccaattggtaacgttctgtggccattttgcataaatcctttgtagaaagttccgtaggaataacttcggatccgagggggtaccaggataattgagtataatggggtttcagcggaagtagactgggagaaaacgaaaaggagatagaacaagtatataaataagccgaggtgggagaaaaagaaatgaaaaagtagagatctgatctatcgaatgcataaatatttcaatcgtactgcaattaccacacagattgattcaatacggtgcctcaaaaacgcccctcagcattcgccctagtgtattgtgacggctcgaaaacatacactataacatcacttccacttcaacttcaacagaagccaaaagccaaaagtcaactatcgaattacttgcctcccatatcttgaaatcccagtcaatcgcctatcatcatctcttgatccatgaccacctccttggaaatgcaatcattactatcacatgtcgggacccagatagaatatcgatgaggcttccactcgcgcggggcaagtgtggatgtccctcgcagctctatcaaggtggacacaaatattttgtcctcgctccatttcatgctaaagcgtccgtagagaccatcattcagatacagcatgtctgctcgcttggttgtagtgtctttctgggttcggcgtgcgatatggcggtatgatcttacacatagatccgcaggagcaactccagcccaggacggattttttaactgttcaatctttgcgagagaggcgcaatcaaagctgacatccatatcggctagcagttgcagcagtttggggtccggggggcatttaccgctgggattttgtcagtcttgcagctcggtgatatagatggagtattactgaccataaaacgggtggatattaggcaatgcatttctctgtctttgatactgttggacgatcttctctgtaccagctacaaagaacagtacgtcattctcgagatcacatggggttttgctgaaggaatgcatcatcaatcgctccttcctcaatgaatgctccgtagcttcccagtttatttattcttcttgtcaacgaccccatgcgatatcttccccggtcgtttagacctgaagttttatataggtagttattcagatgtaatttgtattttttctattttagcaaactcactagtgtagccatatgcagcacgtaaacatttgaaaatcgtttacaacatactcgcgcaaaatttttgggtaagttgaccatgcagatttcaggccacagacacagtctttttcggccaaaatagcaagttatatggatccgctaaggagtgggtgcaaaagatcatcaacatcctagatcgatattctgcccaccttcatccagttattgtcccacgggtcagacagccttgcatgatcgttatggggcgctggaaactagcaaaaaattgcagctataagtacgatcgtaccgacgctttcttgcttcgattcaatctattttatttcagttcggtaaccccatgcaataaattacagggcaagcggaggaatggcagatctcaagaccttgtactctcctaacgatatgaatttgtggcacctgtagggatagcgacatgtaggataagtcagcaactgtgacgtgtcacaatattatatttcgcttctacatcattattagtcgtctgatcatgcacagtatgtataattcatgtgtcttttctctagcattctcaacgcgttgtgtggagcctcgggaacctagggtgagacacggaaagcccgacaagggactagcagaataggaccagaccccagcaaaggtaatgcgagatcttcacgtatactcaccgaagcattgcgtacccatcgtggtgtggtctattggcggagtaggcactgtggcgaattttgctgcggtgatggtggagcattagggaattgactagcggtaccaatagtaataccgggctggaggacagggccatgcacataacacaagagatcgtgccttgcacgcccttaaaatgtttaggaaaacgaaaagaaatattgagaggtcgaggtaagtcgccgccaataacaatttaacaatttcatctcacccaatgatcccgatatcagtgttgtggctgcccttaatgcctccatcaaccctcgagaccatcgtcttaattctcgactcgcaggattcgaagccggggcttattcgtttgaagtggcaaataaaagcaaagaaaaaaaaaaaaaaaagcaaaacgaatatggtgtgtagtcagagattgactactccgtacacattactgcgtactgcaggcggatctgatagttcctacacagctatacctgcatgcgatgcaacctgaatcttcgccaaaccttgccagaaggggaagaatatctctagctgcacaggctgtggccaataccgcgtaattgttcgatcaacattcctctttgtttacaattgatagtttgaatgggtccagttcgcatagtatgaccgcttgcctacgggcataagtttacctgttcagtggaaattaatgggacatgtcatagagccgaaagatgaggtgcattgcctaagttctatcgcgtattccactactgcgtaccctgcttgactgaacaaatccatatagcaccatcagacacagcacagagtctccaggactgcatcgccaagtccctaatccaacatattctccgttaattgcatggtaagtcccgaccatatagcagcgctaggaattaccttcagacaacagcacgtcatatttgggctgatctatcttgcgctgcacaacgaatagggtcttccctgcttccaatctcggacaccgcatctgctccagtagcgccagccaggtagaataggggacttcatcgccaaaaagaataccggcaccctttccccctctaattggctttaggatatattctttccggaggttttctgacgctacacaagcagtgataaactgatcaagggccgcggagcccggtaggatagtaggcgttatgccccgatcaaggcattcagcttgtctgccggtgataatacctctagagaccagagtctctagttcttctcgtacaatgccaagcattctcttgtcgtgagcaagtaggattgtcaaaacaccgaacactaatctggcgtctaatctctggatcaagggcgtttatttcccgttagtgaagttcgaggccaatttaatgaacctcttccacaagttcaccagattcggtagtaatagtgtcaacggcacctgcttgggcgaggcagcacaatttaaatccagtgtccttcgagggatctgggatgattcggagtgcttccggggttataagtcgtggtttaataccaattcgtttcttcgcaaattcgataaacataaagatatcaattccgtgttcctcacccttgactaggtgcaaggagagcttgttatcgaatagtttgaataaccctccgaggatcttaacaagtcaacactagcttcttctttcgtagaccattccttacttactaattcaccgtcgacgcagtgcatcagaccccgagattcaatattaaatgccgaaagcgagtcttaaccaaatcctccatacataaagccattccaacaaaatctcgcattgatttcgcagatacggaatacctccacaccggcttcgtcaatctcaaccaagaagtccggtctccaggacccctgtctctcattccacggtcggaacagggttgtgtttgagtggatccactttcgtagcgacaaatcgttagtatactataataacctattaccgacagtgaaggatgcgtgggacttacgcgtaataaatcttcctctcctagttctaagggcatccgctagggaaactgggctcgatcatccgtccaccatcgctcgataatatcttcaattgctagattcaaggcccgatgtaattcatctaactcatcatgatgccgttgagtgatcaatacgggataaggggatgatgcatctaacgatccagcaggccaagcggaagagcatcttttcagtcttaaggtataagtgtcgcgggccttatctaagaggttggcatctggcttttcggatgatataaatgcgaagtccacagcatctggaaggcagacttgctagagacggtcgaacaatctgtttcgcatttgggatgcttttcaatggtagcgattttgaatgtaaattgaacataaagacaaaggatttatgagacgaaaggaatcgttaattgagttctaattagctaatgataactagcaatcctaagttaactatcgatcactctgtgctaacttgtatacatgcaacttttggtcttttacggacctaagtctacaaactagtgtaaagttcaaatgcaatgtaaccctgatgcgttcttctaatggcccatcattcagctgagtattggccccacaaattgtggacgactttttgatttgattaacatgcgagtcggtcgtacatggtggcgcgcacagggtggcgcgttacacatttagtaccaattacaagctccaattggaaccacatatgcaagcccaataaaagatacccaagggctttcatgcgctgtgcgatccaaatggtctcgcgtcccatcggactcgtcggagatgtcggttggggtccttgacttcattccgagaatgcagccatcgtcgattatccatcaagattattgacccctgaggaaggctcttgggctctagatggatagtctattcctcggctctatctctatacagaatccccttgagttcgtctagcgccttagcagcgttaggagttaacggtatagtgatatcatcccggaatcgtaattgactaccaccttttccctccggcttgactacgagcaagttgctaacaatatactgctctcccaatttcttaagaaattcaggagggacagtgatcttatagttattgctagacagccatttctgtgcgaaaggggagagtaaggcgagcagtcggtcgacgtttagtatcgataacgttccacccccacagcgatccggttgaatgacttgaagagcaaagtatcgcggcggacactcttcatagctgcagtccgtataccaatcaaatcgggacattgtctctgagcgggcttagtgcccgtggctttggaaggccgacggagagggccgaacatcccaaaaccagccgcattcggcactatgggttatcggaagaccataaccatggcttttgtggaagttggtaataagactctacagatagacgcttttttcatcgctaaaccccaaggccaattgaaccactcctttaacctccagagtctcgtgtacagctctcaggtgagtggcctctgaggacaacttaggtttagtaacttcaatcaggggaacgagattggaagttcgtatatctccttttcgtaattagcagtgcccaaggaagccctaaaacaatggttacgtactgataggctgcgtagaatatctagcagctttcacgccaatcgtacaaacagcacggagatagcggtacattttcggcatataaagatcgcagtctaaaaagaagttacgtttcaataaagccgtgactgaaatgggagtctgctttttaacaaggcaagggcttggcgcagtctttttatgcatcaaaattccttataatatcagatccatatccttaaacacgccattttgcggtactatatacctgtaggaattgtacatattactgtagtagacttacgggattttttttctttttcctcatttccttttcttatgggcggaagactgatcaggttgctgtccccggccatcggtggactcgctagcaaaaacgaaagaacctacaagtcacataagttgttctgcaacagcgtaattaatggctcgttcgggaataggtgttttagcagatcatgttcatgtgaagtgatcagcaacataatttactttattgaccgatgcatggtgatgactacccacccatatgtataagcgaactcatacggggatctccggtgatctctatgtactacgctcgtgttttcttactaattatttgagaaaaaaaccaagtcagtcgtgacgatgtcttcggtcccggatctcggcaccctaacgtgtagatgctgctgcatgttccacattggaaagttcatatacctagatgagtgagtgtttactttcatgcaagggcctgtccccctagattcagcaccttctatggcaaatactcacctagtaccatactcagctacctaggattatctgcgacgtcgacgtcttgactcaaagctgaaaatccaactatccatctcctcaatgagcggcaattgcgagggccatgttacgccgatgggctataaatggcgctcctccaaatggtttatactcgcaaccattgcagttgcgctgtatgctggtctgttccccctccctagcttggttaacctcaccctaataccaatcagagacatttctttatggatttctagtgcctttcctcggcgacatgcttcaacatcgtctcaacgtcccgccctctaaaacccaagagttgacattatccgttcttgctatccacggtgcattcgccatgatcgctggccctattattaggcactttaacgatcagactcctaatcggaaggttccactgctgttatcgcttggcgtctgcattgctagcacttgtacggttgcgggtgctcgttcagtacctatactattattaggccgtgtcttacaaagtatcgcgggatcagcagtatagatcatcggctttgcaaccgtcgcggacaccgtaagtgcgaataatataggttcggcaataggattagtgatttcatacgccaattcagggacgattagcgggcccgcaatctctggcctactgtacgagattgtcagttatcgtgtgttatagacaattccgctactagttctacttatagaccttgtcgcacgtgtacttatgattgagcgtccgtccgaagtctcttcctctaagcccagtagcccgctactaaatcaagaagtccaatccagcaccgggggcttctagatctcgctgctctgcaacggccgtatcctaatctgtttggttattacatgttcgagcataactataagtacgagcctttattcgacgcttccctcgcacatccaagagaggtttgaatggggcccagattcagccgggctcctatttgctggtcttactattccaggtattctgatcggtccccttgctagttgggtccgtgacagggttagggcacgatatccagcggtaatcggttctattctccaggcgttatttttaaccctttcgggaattgcagggagcgatagcttctcctggttcagtgcccagactagcggcaaaagtatttactcaacttctgtcattgctatcggcatattgcggccatttgtgtctagtatcgcgcctgccgagttgaccggtaagtggcccttgtcccaaggatttgtatacgacgataatgaatggatattaacagtctattaacagctgcttcgaaaacgatgcataagaagaacgcgggtcatttgggggccgaatatggcgtatcacgcgtaatcgctataatggacgttactgcctccctcggtacgatgattggcccaatcctaggcggttctcttaagacactcttcggttatgagtgtatgagcttcacgtggagtaagtcatccgacatttacggtattcgtcgcttatagttataggttttctgtatctcatgctcgctgtgtttgcaatgtactttctggaatccaaggaagcgaataaatcgccccactctgaagaagatgcttagtgccaggtgctagttattctacgcctatgcaagagaatgaccgcaaggaactcgcgattgatgcggtgaccttcaatgtacactcaaaagaagacatagataccacataagcttgaagacagatgaaagcaatttcttcgaaatgggcatacatgttgtcaggtatctacaaaacttaaaagcatcgataagatattagacagaaattaagtgtatggcgagtgtactagtaagtttggtctgaatgtaacaatctacagtgacacctcttaaatttcagcaccccgtcagctaccgccttcttaaagaaacgcaccgcctacttaaatagttataccgcccattatttaatatttttgattggtagattacgatcggcagaataaggggtgttgaaactaaggaggtgtcactgtaggttgtggtagtacttgcaataccacaatacggcaaaacaggggaacattgaaccttccaaggttggttccaaggttccaattggtttaacctaatacggcttagggtccacccgtggacccgtggatgggtggtttcgggtacgggccgagaagtgggtgttttaaggggaaaccgtattcaggctgtgcaggcactgctgcattaaattcgttattctcaccaacctcaccaacctgggtcaatcggccggtgtagagttgccaacaaattccggggcacggttttacctctccttttacgttttaaatctatggttgtcaatcctcattcgcggtcggggaccttggttagcctagaaaggcagcctaccttccccgaagccacagctgcgacgggatatcgagatgatccgagagccagcctcgtctagggcgagtttgagccaatccagtgcgtgcttgaccctctcgatacttagcacagcctctcccaagtccaacaacctggggccaaaccccaggatccgaatccatggccccaagatgcggctcaagtgatccccataaaacttgaagaggatgcccccgcccagtgcctcggtcgcagtgacctgatcttttgtcaacagggcttcagtgcacctgacgccacgccctgacagcgagatgaccctccaggctccgcaagaagagcatgaactgcccctcgtcgattccgacaaccccatgtgcgatacgaaccgtctgaaacaaggtggaccgaaacacggtaggctgtacaagtggctctcaggctcgaggttcgctctagccctcgcatcagctgcctgcatcattgtgctctgcttcaaccttggcttcctgctctgggttgtagatcgaaatcgcctgaaagatgaccgcgggatactctacgagggcgactgtggcagcgtgcgtcatctgagtacaggactgcacttactcattaacatcctcagtaccacactcctgggtgcgagcaactatggcatggtacatgggacccttgtgtatgactgggcgggactaacagtgctgcagcaatgcctctgtgcgccgacgaggcaggacgttgatgatgcgcatggaagggatacctggctggatattggcattcccagtctacgaaacctcttttacatccccaagaagcggcgtaccatgtggatatgcctggtactttcgtctcttcctctccacctcgtgtgagtaccgcataacttctttattgggttggctgacaggctgtcgctcttcaggtacaactcgaccatcttctctactacagccgcatactcgtacacgatatttgccggccactcctcgcttggaacgcagccacgagaggatcttgaagcaggcgacctgactgtagaagacaccgcttcattcgactggttatattccagcgcccagaatggcaccctgattcacctcgacacgcacgcgtgcatcgacgcctacgcaacaacttaccaaacaaagcacggcggtctgctcctcgtcaccgaggacgtcaacacgactctcacctacgaatgggtcgggttccaggacgtgtataaaccatgggatactcacatccagggcccgcccaccggcgatccatacgaatggttatgcccgccagatgccgacgcttactgcagcacctacctatcggatatttacgccagcgcagagcagggtaactggttcgtgtgtggcactaacggtaactataccgtgaactcgtgcctcagcgcgccgctgccggagcactgcaagttgcagtattcgttgtcgctgacgattgtggtcatcgtggttaatgcagtaaaggcaattatcctgtgctatatggccatcgtgacgaatgaattgccgatgcttacaactggagacgcggtggcttcgttcctgcaacagcctgacaaaaaggccctgggcaggtgtttgatgcctggaatggagatacaagagatacccaggagatccattgtacctaagaagcgctattacccgatggcatatgaaaatacccggaagaggtggtactctgcagtgaccccggggaagtgggcgctcgttgggttcctgtgagcagaccacacccctggcgtaaacgtggagcgataactgaccatgtcgtgtacatcagctgggcaatagcctttatcatatgtgcaggcctcctaggtctcgcgctgagcgaagacggccacgaagtctggaacgccgagttcgggtccataaacgcacaagccctcatcaaaggcaacagctggcccgagtccatggtcggcaacacaatcatcgccaacaccccacaactcatcttctcggctctatatttcgtctttaatggagttataacgaccatgaccctcgccgcggagtggagcacatacgccatctcccgtcgcggcgtccgcgtctcctggaacccgcagtatgcgcagcggagtagctacttcctctcgctaccgtaccgctacgcgatacctctcatgggaacctctgcgatcctgcactggcttatttcgcagagcctcttcctggtcggtattgaggcgtatgacgagcgattcgtccgtgcgccgggtcgcgacctcgtcacttgcggatatacccccgttgcgattgttagcgcgatggccgtctgggtgtttatgtttgcgtgccttgtcgggatgggccggatgaagttcgcgtctggtatgcagattgctggtagttgtagtttggcgatcgcggctgcttgtcatccgaagtatgaccctaacctggatgagaaggatcagcagatggatccccctgagggggttgagttcatgccactcaagtggggagctgtgcctcttgagggcctgatggggcattgtacgttttcggctgatgaggttgagatgcccgagtcgcagcgtgtgtaccaatgacttgtaagggtttttctttttctttttcttttataaaacagagtcgagagtcttcgagcacgccgcgagcaatatcgtttgatgtctggatcgaggggagaacgtataaataatcatccaatgagtggacggatacgcaggacttcctctgacgaggtttactagatatgggctacattgcatcctgaaccaaagctcatcaaagcgaactggccatcattgaaggaatgggtttaatcttggagtagcgcctcaaatcgagtgatgctaaactactcatactgggttcgtgggatatgctttttcaaccaggctggccgtggtcgttgtggggtttcttagatgctctgtatcgagtccattcattatttacctagcagagaagacacacatgcttttcaagtgttctgtctatggccatacaaacagctccaatatatcagcaccagcttcggatcgtctaagtgctataaagtcgtcttcaactggtgttgatgaatcgggaagtattcaccaccgatggtctagctcacaagaagttcttccacgaggtgatttgatcaccccgagtccagttcatctggctcaatagatgtatcggaaactgttggaaaccgttattcactttcataccagatttgagggagggtagcaacgtagaagcaggacaacatagagagacatacttcagattttctcggtccgtcaaatccaaaaacgcagtcgcatccagatctctcccttcgagaccaccctccatctgggactggatgcgatcgcgcttttgattttcccagcgcaacattagaccaaggatgctgattaaaacggcctcaatcaagtgtgacacaatcatggaccagatgccgagctcataggtcggtctatagttcgagttagctcttagttatagaagttaaaggactatcctgaggaaaaacgcacgattgatcagttttatagaagaatggcccagcaatgtttccagtgcagtaccctaggaagagcacagcgttggtgacgactttcttagtatggcctaaatacataatatgattagcttccgtgatttatttaattaagaactagaagaaagattcacataccagcggtgttggccatttgcatactcaaaacgagtacaaatgcagcattgtacgggcctgtcaggtaataacaaattaagcgacctacactgtgttggatgggaacaaagcgaagaccaaaggcgccggcaatattaggaatcaggaagataaggatgaaaaggcatcgtcgattttcgaagcggtcgttgaggtagacgcatatcaaaatcgagacagcaatgataaagccgtatggaatctattgcgtttcatgttagctgaagaccacgtggttatcaaattaatcttacctgcataagagtggtcaccaatgtcgagaacccaaaccctttgatgatgatagttccgaagtttgagataccaccgttgggaatattgcctgtgtagatgttagtcaatgcaccggttcggatctggcacaatcttggaagttacatacaaaccatgccaagaatgaagaacatgtagagcttataatccatgaaagcctccaggatctgatatggcttgagatgcttattctcgacaccagtctggttttctcgtagacgctcaacggcgatgcggcgctctctcttgctaagtccttttgctgtaacaggtgaatctgggaggaagataaacatgacaatgccccaggcagaacatagtgcaccactaaagaaggttagtaaaatggcagttccaaggacaggaggaaattgacatacatcacaagaaactcgtatttccaagacggtagcgcgcctttgaggtgaccaattccatagcctaatagtccacccaatgcaatcccgagtccgtttgctgtataccacagtcccagacgcactggctgttcacgacgggtataccacatgctcgtgatgagcatgaaagctgggtcagcgcaggcctcggcggcaccgccaagggctcgaagaacagcgagggtctcgaagctgttacaggcagcttggatcatgaggaaggcaccccttgaaaataaatgttagtattgagttgtactatctacggggtcagtccaacaaaccacataaaaatattcgcacccaggtatttccctaaaccaattatcagatgtatatccagtcaaattgtccggcgtgcaatgggagaatcataccgattggaagacgctgcatcaaaaaattggtagggaatgcccatgctaagaaaccaaagtagaagatactgctcagccagttataccgcgttccatgaagatcgagatcttcccgaatcccaaaaatagcagcgtagctcaacgttgtctgtcctcaaaatgcgtgctattagcacaaacttttggctaaaaggcataaaataggcaagtaataatcaataaaagaaacttaccttatcaatgtagaagaacgcatagcaaacagccaagtagggcaatatcatgaagtcaatcttccacaatagctttctcgcttccacgggatcgacatcttcgtggagctcgtccgggtcatcaaatagcgccatggccgtatcgccgtcgacatttttggcagacttgaatttggagtgttcttggttgctttctgcatggctgatagtgggaacctcggcgatattggcctttgagccaacatcttgtgaagcatggttcgccatagtggagttacctttgtatgacaggaagtggacaagaaaaatccacgaaattcgactagatggagaatatatatgtaatacaagaccagtgccgcgggatgggacggtaagaaatgtgcaaagtcataatgacaacctcgggacgaccccgagtctccctccatgattcgagacaatgtcgaaaagcccacaaagagcagccatctcgtatcccccgcgaatttcaaagcttgcctgccgcaaggggaatagtaaaggatcatctgcggggaagacccagtacggggcccccacgcgaagacgatctggtcaaaacgtggggaaggttggtcttggctgacgagtagagcagactggaatataaagcacagcttaacccggttcgttgcgctagtcgctctcaacaagtctaactgaatggtaaagtttgtctagcacaaagggagctgctgtggtcggtggaagtccgagaggtcggggattgtgccgctgcccaggtggactaaaccttgctatttaccccgacccatcactgggcgataaatacaggctactacggagttctctcatgccaaagcggccaccgtaggtttcgcctaacctagcttcgccgcgggcaagtttgtaaccggacaagcaacatgccgaaatatttacagaaagataaacaggaataaataaaacgtcaccgaggcaacattagagggagaaggcgaaaaggcctttttataaggtactgccgtggataaacgacagcaatactttcccagtaaaatggtcctgtaataattctccaacaaaggtaaaacgctcttctacaatagtgtcaaaagtccccttcggcatttataatgccaaggatcacttaagcctccaagaaagttaagggttgccgaggtggtgtgattagtccaaaggtatatactggattaccctagaggttatccatattgactgtagatcttagtagtcttacagcattatatatggggattaaaggtagggcatatggaaatttactacactattgtggaacaaccattaagatacactggccagcgaggagacattactcttggctttgactgtaaggacttcccagccttgggctacattgattacgagtctactgagaaagtccatagaataatctagaatcaggtaccaaggtactgtgtatttatacagctgtctaggagtggaacctatgcctggacgggatatgaacggttaccccagcttatccttcatgtggtctttggtcatactcggcaaatttgcgtgccgagatcttctgctcaaacatatgatccagctgctcaaaggtcctgcctttggtctctggcaagcagaagtaagtccagatacaggcaatgactgagaatccaccaaagatgaagcctgtcttgccacgaaggttaccttcatcagggtttatcatgtaaggcgtcgtgagcgtcataatcaaagtccagaaattttgcgtaaagaaaccaatgctgacgccgtatgaccgcaaccgagtggaagacatttctccgcagatcacgtatccaagaggtccaagagtgaggtcgtagaagaagttccagacgataatcaatacgcactggcccatggcagtggaggagttgtaacccggtaccacgtctagaatgccaatgatgaagagaatcacagtgagaatgagcataccagggacgagagctctgcgaccgatcatgttgatgacccaccacgagcagatgtttcctaggacaccaactgcagtcacgccgacgcccatgtcgaacgatgaagaggtagggatgccggcgactataattggaaaagatctattagttaacaaaaatgaatgtggacttgatgagacttactttggaagaagtacgttgagtagctgagcacaaagttgacaccactgaaagagttgatagtccaaaccgacataacaatgagggtccgacggagatcagttcctcggaaacaatccaagtagctagcagacgatgctgattcctcttctatacgaactgtctcttggatctcaataagccagctatcaatgcttccgcccgtctggaatcgttcgagggactttttcgcctctgtatgcttgcccctttggacataccaatacggggattcagggcagaaccacacgccagcaagaaggatcgccgggaaaatccactgaaaagaaaaggggattctgtaggcaaaactgtctgatcgcccaccgaaagccttgatgaggcagttcccgaggagctggccgacaacaacaaagagattgaccatggcaatggtgatgccgcgaagcacgacaggacaggcctcggaacagtaggcacacgcggtgacaaggaacatgccgagtgcgatgccgttgatcaattttccagcaagcagaacaccccgagtgaacgcaaagaactgcaagaagacggagccactggagatgacacatgcgatggtcaaagtcatctttcgacctgcgtaaggcgagatagggccgcagagcagacttccaatcattccaccaactgtggcgatcatattgaaagcagcttgccattccgccgggaggatagtcgtgccatcagcctgggtgtatccaaacaccgcgcggaactcgggagcagcaagaaggcctccgctgacctgcatgtcgtaaccccaaagaacagcagagaagcagaagaacagactgaacagtagagaattccggtaattggtaagggccaccttcaagctcataacagatccggagactccatcagggtgctcagactgcttcatataggtgggatccatcgtcactggagtagcctccaagtggacaatttcaccagatttgtcttgatcaagacccatagtggaaaaggggggaaaaggacaagagtgtccgagggattttaaaggaaattcgatcaagaaaactaagaaaatcctgctgctgttaggtggggaatttcgtagatttaatacttcaagcttctcataccatgtgcctactacctccgcattcttctgggccagcctcggggtacagattctcggccccgggtcatattaagatctggggaagttggctgccaagttcgctttgccgaaggacgagttgagacactaacgtgttccccgatacacccgtcgagatccacatgtacacgtgataggatggagattggacatcttcactttttgtgggaaactgaaaccttcgaaattcccaaaatctcctacggctccgatttccccggcgccgttacccccagaggcttctattggttagtgaatatccactctctccgcgaaattaactccacacctcaccggctccgatagacccgcgacaacaggtgataattgcatgccgagtcctgcactacacgccgacaagtcatccaacccccgttaggtccataaaatatgcacaataatcccacttgtggtgcttctcaagctccgacgtcatctagtccaacactctggtataaaggacgcggagtaccagagctggcccaaactccctagtcgatccaagagtccgaattcattcccttcaagttcgcattttaccattatgggctctccgcagaccgaagagctggccatgcaggccgatcccaaatgccctgacttcatgaaccccgcggtttttcgcagaaataccctccccgcgcgttcttatcatattccctctacatctctacttctcaatggagtctgggaattcaatatgtcccagtcaccaccggaggctcccgagcctaacgagaaggcttctgatggggactggtctagcatcaacgtcccaggtcactggcagttgcagggttggggaaagccaaattataccaacacacaattccccatcccagtgtgtcctcctttcgtacccaccgagaaccccacgggcacataccgtcggaagttccaagtgccggccgagtggcaggccaacaaaccagaggtccgtttgcgattcgacggcgtcgatagcgcgtaccacgtttgggtgaataagtccctggtcgggtacgcgcagggtagcagaaacccctctgaatttgacgtcacaccatttttgcaggaaggtgacaatgaagtctttgtgcgggtgtaccagtggtcagacgctacgtatatcgaagatcaggatcagtggtggctatctggtaaatttaattttcgatatgcgacagtgtgaaaggatcatctgctaatatatctcatggtaatagggattttccgggacatcactttgattgcgctcccaaccaacgatcgtttgaatgactggttcattcgcacagatctcgatgcagaatacgaaaatgcgacgcttctcgcaacaattgactatcaagtctcggagaaaagcactattacactcaatttaattgagacggtagagagcaacagccatgtcattgcttctacagagtgcaccgtggagccaacaaaatccgcagttgaactcagcttgcctgttgccaaccccaagaaatggactgccgagcagccgtatctgtacgaagtggagatgctcctgaaaactcctagatccgacgagacgttcaaaactactcagcgcactggtttccgcaaagttgagcggaagggtggtctcattaccgtcaacggaaaggctattcagcttcgtggagtcaaccgacacgatcaccacccccttttgggtcgtgccgtgccggtggaatttatgaggaaagatctgcttctcatgaaagctcacaacgtcaatgcccttcgctgcagccactatccccctgaccctcggcttcttgatatggctgatgagctgggcttctgggttatcgatgaagccgatcttgaatgccatggcttctatgacgccgtctcacgcccaatggacatggacgaaactcttggatacgaggagcgcaaggcaatgactttccccaagtgtggtacacatacgtcagacaatcctacctggcgggcagcctacgttgatcgagttcattctctgatacagcgagacaagaaccatgctagtattatcatctggtctatggggaatgaggcttttttcggtacatgtcaacgctctatggtagagtatgcccgggccttcgacagtacacgcttggtccactacgagggcgacattcatgcggaaactacagacatgttcagctacatgtacccggagatcagccggctgcggtctttggcagccactgagggtgtctcgaacaatggcaagttcgacaaacctatcattctatgtgagtacgctcatgccatgggtaacggacccggcctgcttacggagtacgagaaatgcttcgatgagatcccgcgtttgcagggtggtttcatctgggaatgggccaaccacgggttgtacgttgaaggaaacaaccagaaagacggcttttatgcctatggtggtgacttcgacgactatccgaatgatggaacgtttgtgatggatggtctcttgaacagcgcccaccagcctctgccaggtctgttggagctgaagagagcctttgaaccagtcaagttggaagtcagtggacaggctttggctctaaagaaccggtacaacttctcggatctaagccatcttcaagcttcatacaagcttgagtcgtttgacaaagagtgagtctaactatcatctcaattgacccaaggcaagctaaccttcctacctagagcaaaaaccttggaaaccggaccgctggagctgcccattctacacgccggccaaactgctgagattcctctcccgacagatctcttccaacacaaagtccacccggcctatctgactattacagttgagcaacgaggaaaggttgaatgggatcagggggcctttgtcgttgcttggacccaacagctggtatcaaagccaaccgagaaaatcccagtcagcttgagctctgctcaggatgctatctcgaccaactccaccaagacaactgtggctgtcagcggagccaactggtcctttgagtttgaccgcattcggggacatctcaggaagtggacatacaactcgacgtctattcttgagccgcatcccgacacagggcttgccatggtacctggtttctggcgtcctccgacagacaacgacgtaccttctgcggcgccctattcgaagcgattcggagtgaacaatctcacaaaccagttccgttcattcaacatgttttcgatggagaatgaaggtgtttgtatcgaaaccgagacgttcctctcgcctccagttctttcctggggatggaaatgtctcgcgcgttacaccatcactcccaacgggtcgttgtcaattaccataagcttgcaaccgactggagctgcaccggcaactgttcctcgtgtcggtatgaatcttcgcgcaaactctaatttgcagtcagcacgctggctcggacttggtcctggagaatcctatccggacaagaaggctgcccagaagtttggtttgtggaatgttgatgacatcgcgtcactacagacggtttatgacattccacaggagaatggaaaccgcactgacactgcttgggtggagcttctcactaagaacggcataggcttccgcgcaagcccgcaacaaagtacagtggtcaacggaggaacggcaagcttgaactggacagctagtcaatactccgataagactattgaggcggcacaacacccttgtgatctggtcaaagatgacgcggtgtttttgagattggatgaccaagttgcaggcgtgggaactgcagcctgtggcccagggcctatggatgagcatctggttaaggtgcaggatatcacctttggtatgctgttagagcctgtttctttgtgaagacttaatgatcggattttagtttgctaaataagctgcaatcccatatatactgctaatatcattccctgataacctttcaacccgacccgctggtcaaatctacatcttatgtagtccacatctatagaaccattttagtgcacgcgcccggtttcgcaacactcaggcgggttttcataaactacccatgactagtatcattcaaataccccaaatccacactttgattcatcacttccatgtaaatatggttaattagatatgcgaaaccgaaattatctgccgaaatgggtgaatcacgtgcacgcccgcgttaacgtcgtccgaagttcatgtcgaccttcccacccgtgtccttgctgctggcgccattaattcgttcatttgctgcccatacaagctcattatcgaagttggtcaaggaacttctttgctaggggaaatctcctcaatatcagtatcctggctcgaaatgaagagattcagggcggctcgagcggtccgtctcattctccctcggctagcaagttggttcgaacatccaaactaaaccacctcacagtgcgactcatgccgccatcgcaagacgaggctagtgatgccacaccttgttttgtagtgcttggcgattgacagactcgacaggtgtgatgctcgggatccatgtggaccctgtgtgagcctgaaccaaacatgtctatacggaacagaagctacttcgtaagtgggttgacgccatttcgaaaatcagcgactgacccaaatcaggagaggcaaaagtgaaatgattttggatacggtcttgcgaatggaagcttctattgaagaacttaaggggatggtcgtacgtatggagtcgccaaaggtcatgtcttacttgctgatgataaaatccaggctacggattccaattcaagggcgatgaatggtatccaggccaactcaacgtcccctggttcaacaattacaccggtacctcaggattcacgccatcatccaggtcggtggacaactagggaccccacggaaagtgcagtgctttcgtcagggcatctctcttcggcagagtctcttttgaggtggtcagttttccgtgatcatccttcaatattagaggaggcagaatcatcgtttttgtcgctcgaatatggacggccgtcctttcaaagcaaactatatggcatatttcccagcgtgggcttgtcagaggtcaaagatatggtaggtatattccaacggacatataacttttggttcccgacaattagcttggacgatctgaaatcgttgcagttgaggatatggcaggagaacctggagcctagctgccaatcgtgtctcgcattattagtcatggcgttgggctgcgtcggcgcttccgtgacagaccaagaagacagttgtgaaagcaggtctgagcagctgaagctgcaaggagcgtcatggttcactgccgcaatgaagatgcttcacttggcccacattgagatgaatgtcgaagcatgtcaatgtctcttgctgactgggtatgccaacattgctgccggctgaaacggcgagtcaagacaaagctgacgaatatttagactctacttctcatttttacaaaggccgctgcaaacatggtcttatgtgaacagcgcggcgactcgttgtcgtttcctgctctcttgcccctttgacaatcctgagcgcgacgatcgagaacgcatcaccagaatattctggtcttgctttgtactagaaaggtaaggacgggcaatgaaacgttacaattattgcagtctgactggccctagcaattatatttcagaattgccatcccttccgcaaaactgcaatgctgagatcgaatcaatattttcactcccgggcaaattccactcgcatgaagctattgaagaggaagaaaagtcgacattctactttctcgcatcgatagcactccgaaggctcctcaaccgagcccactacatgctgtatgaccgcgacattggtcttcaaattgattccaataattttccatctgtgaaccaagagctggcgcgccagctgcaagattggtatcaaacactacctccgagtctccaatttcccgatgatggaaaacccgcagatgatccgcatagcgagtatttgagacagtggtatctcagttgtcgaagtgtcatctatcgaccttatctagaatgggctctctctaatccactgtgggacctcaacaacaacctgcgtgtactcgatggttgccgggttgctctcgacacttgcctattcaaattgaggtatctgaagcaggtgccgtataccgtcatggtggatacatggccatgctcactttcgtatgtctcatccaggcctctgggctgtggtacattattactgatataagaaatactcttattaggctcgaaacggcaatgttgactctcatgggcggcttctgtcatccacagctcacaatgcagcttcgccatattgccttactagaactagggcctcacctggagcagcttttacaacaatggatgacggtccatggatcctccgtttctcctggtgtcgagaaggccctgagattgatcatgaaagctcacgagttctttgagagcagaagtgccgactttgctccttctcagggtgaagaacaacgtctctctccaggatcccttcgaaagaacaagggttgagtacacattgatgaaaagaatcgcctttctgcgtgatcgccgatgaatacgtctagtcaagactttcacgattattacctggtaggacccagcaacagaatcccattgtacctccctaataaaaataaagggcaagtcataaaccaagcctccctccaactgtatcaacccagtatctaaattgggcttattatagcttcaggagaaaccgcccacgcgtgcagtctatctatggtctaattgtccactgatcatccaacaaaaacaccgaaatacgcacctacatacattgataatggccagtaggcacatattagcataaagatcgcatcttggaagatcacgccagcatatatgggttgaaattcgagatcagatggtattgcatctactatacttaaatcgtgacgcattccgagtataatcgagtattctatctatccagaagagcaatagtctgaaggatacgcgtctggttatggtataatgcgtccaaaagccttaatagcatcttacttgagagatattcgaagtcacgttccgtctcaccttccatatttagctctcgcgtagcccccagtttctcacaactctcttctctctataatacgttgaccatatccatgccttgtcttttatattgacattctcaacatgacgtctactcgcagaggccttggtctagatggaactgcctcggtccttggggagggataccccgaagactcaggaaagcaaggccccgagaagcgtgtcagttgtcaagatcaaccacctgaagccgaaacaaccccggccgatgtactggatctacaccccgcaatgaccgaggagatgatcaacatattccgacggaagggaaggtactaccaaacctggatcaattaccccgaggactccaactgccaaaggccatgtatcgtctcgccatccacaataaagatggaacagctgatccacccctccgatgagaggtatcgatgggacgagtactgcaatgaatgggttggtgcaccagaggaaatcggcgatcctggtccactcaatctccccgttggactggattaccacaagctacatcttcgcaaacttggagtcgagaaagatgggtttgtgggttggaataaataccacggtcgtgtggcacacactgctatcttcgctgacaacaatgtcagacttgatggtcctcaatggtcgcaaattgctcaggctcactacgaggctttctttgatatcgagtctctgaagtacgtctttcgcatgaccgtcgtcaacgaggacacacatgcctttgtggtcaaggtgctatatccgagatatgggcttgagcttgcgggagatagccaactgaggacttggctgtacgatactgatgattatcaggagattatggggacaccgttggggaaagctgtcggtgctcttgtcttgggtgcttttcctaggggtacgcgtcgcattctccaaattcatacttggcagtatgatggagacctgcagatgcgatttgatatttccgatagtcttcaataacctggaatgcatcctgagatttgtgaagtactgcagttggcgtatgtgtaagaagacattagtagtatccgcgagttgatgatgcagcaaaagctctgatcatattcagggctgtatacgaaatttgttgatcgatcagggaccactattccgttaacatagagagactacctaattccatggtgactgatctgttcttctattggtaactcggtggtgtaccttggtagagccctccgtatcctaattgggaaagggcaagaaaagaaaagtggtaacccaggcatcgcctctagattattgctacccataaggggatcaaaataatagttggaaacttttggatcatgaacttctaagcggactcatacagctaatgaaagtagctaattccgctttgatctcggaagctgtaaggcctacctagttgcgtgagcaaaactgtaggcaaggacacaactaaggatcgataaaatgtgaagaaaaaaagatatagcatgtcctggtttcgatccagggtctaggtattgttagtttgatgtttttatggataaatggcgtgggaaccttgacttacctccgggtcatgagcccgacgctccacctgctgagctaacatgctgcttggttggaaaaactattcctttgctagtttaaataaaaacatattagctttatgaattgccctttgaggccattcctaggtctctaggatggtgtggctggcttgggaccgatttatacaaagccagatgtgtggtttatgttagctatcatggtttgggtcggggtcgaacaggatctagctaactagcctagtgtgagtatatacatgagtactagttgtcaggctagtccctgttattttccattagttaggcgagtagtacgagaggactatcttgagactatacaggttgcgtctacatagtatcggtctactgactatactgagacatatagattcattccaggtatgtcaagaattactgtcattgccactcaagcagatgagagactttgttcatagagcactcgccatgacgctgaccgtacgtttcggtgtcatcatcatcaaattctcaaaggcgaagaaattctggaaggaagcgaatagaccaagcaggggtaattagagtcagtatattggacgcacttttctcccagtttaactaggcaaacaaaaaggcaaacaaagataccttacagtaggaggttggcagttgtttcttagggccaactatgtggagcattacccacactggcggtccgtcccgtgtagtttatcgtccacgggtgttacctaggtacgcacatggtactacctaggtaagtattggggctctattgatgtttaaggagacttgcgaaaaatacagtcagctttgaattaacacctcgattggaattgcggctagcgcgcttggggcgagggggccacaaagagaacagagtcagcacagcccgcgctaaaagagcactggggcctaatcctcctatcctccatccttcggttctcttttcatcccataatctgttccaacgtcaaagtttccttccgaatccactcttttgacgaaattctccagtgttacctagtttccgcactgccagtatgcgaccgtccctctatcttctgagcctcctcggagccacgacgactgcttttactgcgaatattcgtacaaagaactccgatgtcgtgtctttgacccaggagacattccatggtttcatggaggagcatgacttggtcttggctaatttctacgcgccgtggtgtcgtcactccagaaacttggcccctaagtttgagcaagcggctacggagctgaaaaatgacaacatccctctggtcaagatcgactgcacacgggaggaaagactctgttcggactttgctattggtgcatatcctactttgaatgtgttccgagggcccgagtcgcatgagccataccatggctctcgtcgagcagaatcgtaagtaacccgctaactggaatagcacctttcaggcatgctaacatgctggccaggattatctcatacatgatagacgagtcgatttacactggggctgggggaggcttgtatcttcaagcctatgattgaaatagtcccatggactgaacgtggtttatcaagcttctggtttacttttcgacatacagtttgggaccaggtacatctggcaattgtggctcagactatgacttatggattttagatgaagctgcatatggataaaaatatacaacattctggtttctactttttgctttaaggtctcggatagccaaatacaccacatcgcgtttctactccttgtatattaggcaaatcttaggccctatgtcctacacatcgtattttatctatatcgaacttagttaaatatagatattgtgacaagaagcttctctattggtacaaagacatccagatctgtatcgttggcttctgggtagcgcgagcaggcatcagtccacatatcagagtaaagaaagtgtgtatattctagctggctacgccgtacgttcacgaaaacccagaaaacgagagagttgaagcaagctcaaagacaccttcatccttcctggcgtgttccttgaccaattcctctctcagctcgagggcctcgcccagatccatttgtgtcgcagactcagcgccatcgcctcctgtccaaccagtctgctgaggtgggacgttccacgtagagcaaagccggtaggtcggatcgacaagagacacagtgagaaaacggcagtggccgggcttggtcttgtcctgaagctgtaatgggcccattcggcgctggaaggcgttggggtacgagatcagccggcccggaggcatcttcacctcgccgagctgttgccaggctggactatcctgaatgtcctcaaatccgcaaagcctccctatatacttgacatcccatagggcatacttcaggattaggtcatcgatttcatctgcaggacggtcctcgttgtccgaatcgtcggcaccgattcggtcgtagacccaggtacggggccctagtctacacctctgccggaagctgatttgcggctcgggcatgttttccgaatcaagcgcgtagatggcgttggcgactatactttcgtttgcatttccttcggtgtgccactcctcgccggggaaggatggcgtctcaggatctagctcgatgctgtggatccggacgacagtctggagaccccggtctcgaaactcatcctgcaatgcaagcgtgtagaactggtgatcgtcagggtcctcttcttttggtttatacatccattcgtagggtgtcaaccaaggatttgctccaaagaatttagacagttcataatccggactgcaaacgtaatcgaagtgcgctgggccaacgattgattttccagtcctccctgctttccagtcctcgtacgagtacgcagttcccgggcccgagtgctcaaagacaaatgtgcatccatacttggtcaaagctgtgcgaagcaacccccagcgggccttccaatcctccgggatcctttgcgttctgacctgatcccagtataccttatcccttgattcaggttcctgaaggtacgcctccacttgagcacacatggcttcgtattcctccgcagagagtttatcctcgttttccttgtcgggcaattttttcgcccattcagggaactgggctttccactcgactccgtaagtgcggattcgtatgggcccacgaggccaggagacgcaattcccgtggaaaaggccaatcgctttcctccacttgttacgaaccaaaacctcgttccattgcttgatgctaccggagataacggtctcgattgcggagtacatctcgtggtttgtcggatggagattgttgatgtaagacgaaattcgaacatccgtagacccaggaggaccagtgaattccacttcacacggcagccactgaaacttcgaggaccaaatggaccgaccgccggccgctgaccagtttgagcccccttttaccatttgtgggagttccgaaacgattgagccctctttactgcgtgacgaccaagaatcctcgtccattccacacgattgccctccgaccagggttctcgttctcccatagacaagaggaaacaaagatgggccgacgaggtttaccacagctgacgctggcttctgccgaatggcttgatgagataacaggccgacaaaattcgacagctgtgacttcatgtcggaagatattgccacatcggatttacaaacaccgctgctcgtgttgaagacgaccaaacggccgtctcggtcaaactgtcgagccttgtcttgcaactcgtgcaagcaccagtcccacgttttgtcattgatcagcgacgacgatgcaacggcgtcttcccgccattgagcggtaacttgctgatcaaagatggcgcggtgccaatccggtcggtcggtgatggtgtttattagatctaggatggccagttctttgaccgtgagaatgtgaccataccagtcatttacccctgtggcgaattgatcgtgggagagtaacacattgatgggaagatcatggagaccggggactttgagggttgttttattatccaagggagtttcaatgatcccggccattgcttcagtgaagtggtgagatactggaatgaagaagatggaagaaggctacttgtaaaaatataagaaagaataagatggtagcctccagcagacccgcccggcatacagaatatgtgactccttagggtgggaccgcagaagcataatagcaaacctggacctcgtatcaacctataactaactaggagagagttcctggactagcagcgtcgccgcattccctcataaggtcttcctccgttggaggtgacattccgtgtaactactaaccaagtagcctaccaaacggtgcctcgcccagattttatctaaactaggaaagtgacgaatagtaaacaagccaattcgaactattgtagagctagagggcgcgatgaccaatgccaagtcgatgccaagacagctaagcttaggtcaagcctacctaggtagagatctatagaggcttctggacagttgttggaacttctcggctggaatttacctaggtagccaagcatggtaactacgagtgtttggattggggacggggaaatatggcaaaaatacggcaaaaatacggcaagaatatggcaaccttggaagaatatgcactttgtttctcggcttgtacccgaacgctaatccatatatggctagttcaaaactaaccccagcttagctgtatcgctccgcgtcaaatgagtcattgttaattaccgtacggagtacacgcctgtcacaacggcaaatctagcgactatatttatccggaaggtcttccccatggctctttcctacaatcgccatcagggaaagcaaaaccagatcgtagatgcgtagaatagtagaccctgtacaacacctcctaaaccaccaattctcttcaaaatgccagccacagaagtccccaaggctgtcgtcaagttgctgcatggaatcaaatcttttggccgattaaaatgacagaatctggcaagccgctttttgtttgtcattcttgttctgctggactatgaccatcacgtttacagaactggtccgggttatggctggaaggtaaagtgcacggaaagttactacgtgtggggtgacgaatccgatgaagggcttgagctagaaagctctggagatatctgtcttcttcaaagataccgatactctacattcgccaacagagacactccacccccgtaccccaccgacctaaaggggctattgcagacagaagttgcacttcgagagaatactcaacgcgagatagccttgaaagagaaaatagaggaactcgccaaggaagacacctacgcgactgtcgttcaagacttacaggaggaactgtcgacactatcgaaggaatattggaccttagaacgacgttggtgggagattaggtcttcgtattgcgacggtccgctggccagaggtatcgaattctggcgttcacagccaaaatggtatatgcatcgagtacttgtggaagattgcgttgggagaggaggctgttgtggcagagactgtggatgctgttctcatcgccagtcagaacggaaatttgcagttggtcattgcaccgtggagtgttcttgttgcgagagagcccgggggtttgcactcgaccctgagcagaaatcccaactccgcgagaccttcaaacttgattgcaaccgtccgcgtgcatggtattatgatcgaatgaggaccgcttctctgctggggttgatggccggtaattatgaaaaccctttgaatctcatcgttgacgtgccgccaagatatacagctccctctgaggaatcgcaagggagcaagtggaaaaactatttgcggggatcttcacgctaacgtttccaagagtaagagccggtcaactgcttcagaaagttatatttgctgttactgttcccatttttgtgtcgctgttatactaaaggacgaggtatccagggatatagtggtactaagagagaatggagaaaagatatatatacctgtcatcattgctctacctggctagcccttcgcataggttcttctctccccgtatattcccagcaccacggacccgacgatcaagaccctgcaataccttacacctcacactctctgagttaccactgcgaatgatgtaccttgtcgtttttcgctcctgatatggttactgtgctggagttcattaactagggatccatctttagataccataccacacttttttcaacccttcgcatacaattggatcatgtatttaatatcgtaatgtcattgagggaatatgaagctactgtggggaccattcgagtgagggattacatgtattgatattatgaagaaaagccagtacattttgaattaaattttaaacacatatcgcgatttagatgggaagaatattctacgcaaagatactttatagttagccagtctctcgacaggggttagcaagaccatatgccgctgcacatgtttatcgccggttgaagttcaagaagcgagactgtatcaaaatcaatcagcatcgcaatcacaaagatagaaacaaggtggagaatatctgcacttaccgccaggaacaaaataatcaggttggacacaataaacgcagcaaagatacccagatcccgccatctgttatcaaaggacatattgaaggccgcgtagaactgctctccaaccttgaacgcacagtacttgcaagcttgcgctgcatcgtcgacaatatatccattaccaccgcggtcaaagaacggcttcatgtactcgccacaggtgagattgtccggggcattgaaaagattcagctccgactctgcgcaaaccacgtcccgaccctgcagttctgtcacgaccattccgccgatcagacgagtgaatgggtcgaggtcgtacagccatgcgcgccagaagcctggcatctgaggcttggggattgcaacgccacagaatagagagaagataatcacgatcggtgggttgagctgagaagcgatgaagctgttcggggtcagagctgagatcatctggcccagagtcacggagaacatttctgtaatgaggattatgaggaattggtagccggcgcggttggattcggtctggaagcctgggatgtagtacaaggggaggaagaagcagacggcgcacaggacactgtaggggatttcggcgacaaccattgacagtgcgaaggcaaactggctgtaggtttttgatgctgattcgcggtagaagattagacgtgccatatcgtaccgcggttgaaccatctggagaatgatggctgggaggacggtgacgttgaaaatgacgaaaatgcggtattgcagcgaggatcgagagtcgtcgagttttaagaatacgagacccgtgataatggagatcacaacatgagtgtaaagcctggtgaaaccgtagttccttgagcgccagaatgatagatgtgttcgccgaccgactaccttgatttggtgccagagaggtgaagcgtactccctatccaccttgttctcatcatgattgtcgcgaacggcctgggcacgactttgcttgatctggatgatctcctgtttgacttgttccagctcaggagaagtgcgccaaatgtcaccccagtcacggtctccaatccgacgtgtttggccagcgccgatggcatcaagcatccactcagccacattagcatcctcgggacagtgggctccattacgactgaagtaatccagcaggacctgggaatcatggccaatgtcaccgtggtaaatgcattcacctcctctttggagtaggagcagacgatcgaagctttcgaagagggcggcattcggttgatgaattgtgcagagaatagcctggcctgctgctgctagcttccgaaggaaacgaacaatgttccaggcagattgaccgtccagaccagaggtaggctcgtccaaaaatagaagcagctcaggcttcgccgccagttcgacgccgattgtgacccgctttctttcttcgaccgagagaccggtttcaggtgtaccgataatcgcatctgccaggttctccagttccaagagagtcaggatctcttccacgtaagcgtacttttccgattggggtgtctcgaatggctggcgcagatccgcagagaaacgcaacgcttctcgcacagtctgcatgtcctcgtggacatcaagttgctccgcgtaagatgtacctctttggaacgaggtgcctgggggcttgccatcgaccaggatgtcgccggtaaccacaccaatgttctttctggctgccaaaacgtccagcaatgttgtctttcctgcgccggatgctcccatgagtgcggtcaactttccaggctgaacatagccgtaaacggagttcagaagacgtcgggtgccggatggcacaggcacttcgtaagagacattctcccaggtgaacacagacttggaggtaatattgaggtttgatcctgcgtcagtctccaaggtctttgcctgtctgcttgctttcttcttcatcaaagactcatttagctctttccgctcggcgttttctttctggtagaaagtgatggttttgccgcctgcaccgaattgacgtgtctctccaaaatacaaattcgaacccaggaaaccaacaatcagcgcaatcatgatgccgaagtttcgccaaagatcgccattaaggtagctgaaggtttgcgcaaggtacttggagcctgagatgatggcggacccagggtcacctcctgctagagtacaagcctggtgcgcaatgtcggtataaccaggtccagttggcacgagtgagtctttcgtacatgtcaaagtaaggtgcctaaactcgttcaccatcaaggaagcgaatccaaggccgaaggggttgatgaagtaaatccatcgcagccacacctgagcgccagaccactggataagatatccggacgtcaaaacgaagaaggtgataatgacggatgcgaacttgatggcgtagtcgaaatcaggacataggcatccaacagttcggaagaacactgtcatggtaacatagccctcgaggataatcaagacaaatataaagaacgcgccagcatccagaaccagtccgcacatgaagtagacgatgatactgaatacgagaattcttgcgatggcaaacgcagtgtccacaataatctgcgcaataaatagtgcgctaggtctgtagaacgtgaatgagcggtgcttgttaacaactgcgcggcccatcattgtggctgcaagttcggagaatgcttggaagccgttgaacagcagactgatgaacaaaagacctcctcgagtaaaggcaccggcactcgtcttgggttgatcaagccatacagtacccaagatgatggcaataccaacagaggtaacccatgagacggtcaatgcaaacttgtcctgccatttgaggaggaactgtcgttgcatcaaagcccaggtttgcaggtggaaagggattgagtatacagatgatttggaagtaaacttgcgctttgcctctttgttggcgatctcaaagtcatcgtagattttctgttccttccgaatctgctcgcggtaagatttcatttcctggtctagcgtttcactgaagaccgatttgtcaaaggcttcgactagtgcttgcggcgtggagggcacatcgtcggcacttcttccatctttgaactccctctcgaaggggtcagtgcatcctgtcaagtagtcgggggtggtccgacgaggcttttcgcggaacccaaggtcttcgaaatatgaccgtgcttcggaagtaggaccaaagaatacttggcggccgttgtcaatcacgaggaccttgtcgaactgcttatagatattttcggacgcctgatatagtgagacgaaggttgttgtcttgtatatattggtcagaatccgcagggacttggcgaagtcgagggcagttgaggcatccagaccgcgagtgctgttatcccaagctaatacagtcgcagaggtgatcatcatctctgcaatcgacacacgacgccgctcacctatgctaattagactctgttcccatggagctgctgcacatataaaacattccgcttacctccagagacaccacgaataaactggttgccaatcacagtgttggcagtgtgctcaatgttgaacatcttcagaagcaagttggtcactttctctttgaactcggctttcgacacaccaagtgggcgctttccgggggttttggtgtcgagcgcgaatccaagggtttgtttcacagtcaaagtaggctggtgaacatcatcctcttgattgtatacggcttctccacggaatcttttggcgaacgaatccgagtcaaaacgaccataaaggacctcaccgtccaccccggtgtatccaaaccgctggttcgcgatcactttgaggaatgtcgtacaacctgatccgggccggccaaggaccaagaccatctcaccgggacgtgtgagaccccggaaaccctctaggatgttgtactcttggccttgctttctccaaccgaagaggtcaatgagtgttcctggtagattgaggaaatcgacgattgcatctgggaaggttttgatatatgtcttgacgccgcccattccagggactgtcaggttgtcccaaatcacacctaggacagtcagtacttgtttttttttttttttttctctctctcaatgtgagggtctaccaaccaatatgcttgtctttgataccagcttcttcggaggcggcacgatcgccgcggagagttgtctccagatcccatgtgtcatcggatgcagtagaaccctcggccttctcgatatctttactggtgactcccttagatacccgtgactcttgtctggataatctctgggcttggtgcgagatgctggagaattgtttgctcagctccgagaagtccttctcggcggtcgtaacatcgacacccgtctggaacgtatccgccggtgtgttggcgatgcgaatttcttccagctggcgtccatagctgtttgaatccagggtgtccacatctgatttgctgctggtttccgccatggccagcttgtggtccgactcgatgtttgccattggagatcttaaggtgcgggagagttaagttgtgccgagggccgatcccatataaactctccggcacgtccacgctcccccaagagtgtgttgaattattggattatatcccggggaggtccaaaacaaaataagagaggtaagatcctatcaacgtttgaagcccctgaaacagagcgtttaaagaaggagggggaaaaaagaagctagaagaaaacaaagaagctaagcccgaatggtccttggtataagtcgggtagtatctcaatggccagccctctaaatttttcagggatggtgaaaatagcggtcttagatattttacttaggtagctttcagaagaaaattgtgtccaagcagaatcttccaaagcccaaacaaatgtgggggcaaacctccagggacggcatattccgcggtggagtgaccagatttgaagatgccaagcagacgggcacctaaacggggttaaagcgtaaaaacccagtcaacatgactcgcgatgactcgttactcgtgatcactctgcagctatgattataaattcaatcgcattttgcagaagatcttgttctagagcaaagggttcggagcgtttatcgatctagggttgtggagagccaattagtgtcctccactttacggagtagaggcaaggacaatataactgaacatggatagaccctgaaccgttcatcgatgttgggaaaactggctttcaatatcgtggttatgatccatttatagagaatacgaatcaactgcatgctctccctacgcataggcttgtacagagtatgtacattgcagtttggcatcagaacaatattttcgttaaggtatctatgttgtagatgcctagtgcgcatttgcatttaggcaacttagtaaccttgattcagaaatatcaaattgaggaattactgggccctttattctgtatcagcactcatctggttagccccgggatatcttcggccggcatatcttggtctgccatgtatgttgtagtgccgtaaaaggctaacatttcgagaaggtaacatacatatccttggaagcatcagtccacggagtaataaaccaactgatacattcgtggactgaacaccatgtcattattgggaaagcccgcgtgcaggacgtgcgccaccgtgcgtattcggagtttctagaccaatcaatgctctcaatatttccataaaattatccgtaaatatgtcgctccatatattctactatattttaagcggtcgcaatttccccagtggcgccgatttataggggtcccgctgagtatttcacagcatccctaggtaggatgacttccaccggatggcttggcccaagaaggaatagtgcaaccacgtgataggtgggtcactttttatcaatctatccatttattccttgatggatatctactccgtccacgggtactgagcccgcgataaagtacttggtcatatacgagacatgacgatgaatggacaggggttgccagttgcaagctgcaaatcgcacaattcgcgcagtgggccgcaccgagacaggtaatatcaatcgaagcactttacgcacaaatgccgcacagaagaaccaactggatggaatagaaaagaagaactgacatgtttccggcataaacgttggtttcaacaatttgactccagctctgctaagatatatatatatactaccaaacttatctatgtgcctatcccgctctccctctttcccttccatcaatccccgaaatctcaccttcgaatcaatgccggaccatcagtacaagttcaacgtccacatgggatgcagcggctgctccggggctatcaaggaagctgtggaaaccttgaccggtgagtcctagtgctgcttttatatccggttataattttcaggacactgacatcttcacttttgtacggtgtaggggtgaaggattcctctatttgccttgaagatcaaactgtattcgtggtggctgaaccttctctctcctacgaaaccgttttgggggctattaaggcgaagggcaagaacgtgcgcagcggggaggctgatggagttgctcagactgtttaaggccgttagaccatgtcagtcattgctggatgatatagtactccatcagttccaacttcatcggaattacgagcgatgaaaaacacgtccgtttagaccctgtcggagcaagtctgggcgtgcttctgagaagcgacaacatctacgttagcctacttatgaaaattaggctatttatgaagaagagcatttatggtctttacgtgcaccgtaatttttcatttgccgggcaaaattgtgccctgttgataatccttccagcatagagtcgatgcatactagtgttatggaaaaacaaaaagaaaaaagaaagaaagagatttcacatccttcacctagaaaccccgtcgtcggctcttaatgatgacagctgtgatgcccctcgccatcgacctttcccacccgattcacttgctcccaagccgacaaaccgacacagatcgcaatgcgccacagcattctaggactgagcccctcgcgccacacgccccatacaagagtcaaaatggaaatcgccagaaaagcgtttcgcagtttctcaatgccagcagtggccaccgaacccgcaaagagaaagtccaggacagtctagaaatttagcacacgcgttcaacagcctagtaacatggaaaataacatacgggcagccaacaacacgaggatgagagcaaggcagatccttccggtagatatttgacgactaattgcacgagtctttgtagaacggacccgtcatcgtggtctgggttagacttagacgagagtttgtctgagggtttgtctgaggtgcagtcgctgcatgacattttgaatatatgagaaaaatggcccgagagaaaatgaaatggagttttgaagcagtactatgggtctaggtccactggatagatatatgtctgcgcgattttcgcgtcgtccgagaatgcacccctgtacactatcgatattcccaatgcaaacatgtcaaacacaccaagagatcgttaaagttgggaggtgccatttgtctataacacagacttgtccaagcgatattctgaggattagagagcagaaaatccacggatgcaaacagtacatgtagacatgtgcccgtaaggcgaacttgcaaggtcagtaccccgcaatgcggccccgtcaactgccaataatagcctccaaggcgtttttgggggttccactctcaggtattagtgggcacagctctgcctctacctaggtattcgtaaacaagacaacttctctttcccaaccttcaagacgaaaatggccccactcaagatcgtgctagacggcagttcgtccaccacacgccagccggaacgagctgccctcagcttcgtcgtcaaggcaactgggaaaaaccgagaaagcgtgtccaaggaggtcaccgagacatctaacgagatcaaccggctttttaaagacctgtcgcccaaaacggagaccggcgaaacaatcaaaggctcaccagtgacctctttctcttccacctcgctacaaacatggtctcaagtaccgagcgataagtcgggcaagcctctacctactgtgtaccatgcgactctgtcgctcaatgcactcttccaggacttcaccaagcttaacgaagtcgttggggggttgttttcttaccccaacatcgagatccagtccctcgagtggtgtctcaccgaggtgacgcaaaaggctctgagttccgaatcccgtgaggaggcaatgcgcgacgccgtcaggaaagcaagcgactatgctagggtcattggacgagaagtcgttgcggtggaaataagggagtcggcgggtggagtacagtttggaatgaacactggacggtatagtgcatatgcccagcatcatctgatgatgcagcaaatacaggcacaacagcaacaacaggcggctgtctttccctctgcttccaacatgagctcggattcaggcgctcccatggcacttgatttgagtccgcagttgattcgctatacgaatcaagtgcaagtggaattccaggctgcagatagttgagacgttgccttggatattttgaaggtaatcttgcactggatatgctcttgcactaggtatgcttttgtgatttccaattgtactttccatagcttcatattatttttgaagggaattagaatgatattggcccgggtagatttagagctatactcgaagaatgtcgttgacaccagttttgagacgtcccgttcatacatcctagatactcgctaggtgcctgtatctaaccgtcccggcctctaggcctccggcccatgctctgtttcactcagtgatcaaaagacggcaagtggtagggcactaagaaaccatcccgcgcagcctgaagctcgctgcatatgtattaatgcctaagtcggtgtcgatccgggacgctcacagtgacccgtatctcgatgtgcgcatggtgtagcttcaattgatgcattcacttgcgtaggattaagtcaccgtttcaattcgtgattcgtgagttacactgattataccgacaaataaccatacagttccccaagtatacggggatcgattccaccactccgatattcccaaaggctaccgataaaccaagacaaagcgcaaagcgtctatgcagagatctccttaatctgcgcctcaagtttcttcatgtcgccgccaacaacgcggttgacttccttgccatccttgaacaccacaaaggtgggcatagcgttcacgcccagttcccgcgccacactttgcagcttgtccacgtccacctggatgaaacgaacgttttggtactgctcgctcagcttgccgacaacgggggcgacggccttgcagggtccacaccaggttgcgaagaagtcaacgacgacggggccggaggaggtgagggctttgaagatgacttggctgttgggcagatattagaatttaacttattgagcgctgaagcaagtacgacttacttgtcgatctcggtgacctttccgtgagacatggttgctgctgagctcgagttgcgtgacttaaagaagaggcggatagcttatgaggggttagtgtttggttgtttgtttctgctggaggtctttcaagggtgttttcgaaggttgagatggaaagtggtgcgtggaagtactcaccaatgtatatcgcagtgagaattaggacggtcttgagctccatcttcagttgtcgttcccaagatatttggtggagcgtcgtgttatttggcgtggcacgtgacctgacactatgccctaatgagaggcacgcgatcccgacatttgagggggaatgattggtctcaagtaggtctcatttgaaaatgtcttactgtgatcaagctaaacctgggtctcggggatctagtgagtttaatccgactgcagccaccaaaagcgtctaccaccggccggacaagtagtgtgtgatgatctggagacaaatccagatattttgtacatgccattcggacctgattgagagaggatattgatatatgtactatgtagtcggcaaagataacaagtaaataatatcaagaaagaaggcgtgccggagtatcttgaatgcaggtttcgccacggtgatacacccctacgataccctcaaggccggtgataaaggacttgtttctttcatatcggattcgtcaggagtgtgttttcattttttgagtatagcgcgctctagtttgtggtggttctgaagcgagatgaaccactatatcaaacgataatactcaaaaaacgatgctttgaaatatcgacttcatattgaatatatataacccgcctcccgattggtggacatcatatttcacattctttctgataatttgtgtgtacttttactctggaatgcagcatccaggagctctagctaagaattccataccttcatcgtcaatagtcatgacctgaacgcagctaacaaccccctcatttctcatactcaagacccgctggaaatgaatttgcagaatcaaaaatcgaaaatagagcccgagtccagctctaatgacacatgcgccagttccatcgtccagcccattaccacaagtaatgctccgagcacgaccggatcgatgttacgcctctccttatgggtctcgttttccgcatggatctcgaattttgacaatggctacgccggcacggtccttatcatgccttcttacaaacacgcatttggaagctgcgagcaagtcctagacccgaacacgtatgccaacatccagtattgctcattgacgccactgcaacaatcactcatcagcctcaacttcctgttcattgccatcggaggcgggattgcgggcgtgacaggtcaatacattggacgcaggggttcaatccaggctggatgcacattggctattatcggtgctgctggaatgcttggcaccagtggaagcttcttgcgctacatggtgtgcagatcgatcagtgctgtgggtcttggacagctaatggcagccagtgtcacgtatggctccgagtgcatcgtggccaacaagcgtgggctgtctttagggttgtataatgtcgggcttgctggggggaatgttgctgcttttgcggtgtgcgcgggttctgctcatctggagccgaccaacgactggcagtggaagacacccattctatgccaaatacccctgggagtgattctcggtgctgggatcctgatgctccctgagtctccacgctggctcatgggacatggccgagaggaagaggcgcggatctcgttcagcgtgctgtacaatcagagtccatattccccggagatcaccgcgcagattgatgatatcaggacaaaccttgcaaacgagcgtgaaagcctaaaatctgtttcgttctttgatatttatagtaggaagcatgtcggtcgcaccttgacatccgccatgatcatggttggaatcgccattactggtatccagtttgtgcaaccgtacgctacactatttctcaaaggagttggcatcagcgacccgtacctaatcaatgtcatcattggcttgtgcatcctaggaggatcgttttttggcccgttcattgtggaatacggcgggaggagagttgccatgctttcgggctacattgtcatggccgtctgtatgctaactctttcatctgtgagcactgctcttggaatggatgaaactgctgagatagtgacggttgttcttctgtgcttgtgggctttcgtgtttggtgggactattgctgctagtgctaacctgtcttctgtggagatgcatagcgtctcacttcgcacctttggccaagccaacacaacagtattctatggtatttttgcctttggtgcaacgttttggacgccctacatgttaggcgcggcctacggggacatgggtcccaatgtgggctatttctatgctggggtcaccgcggtcattgggattttgaccttcttgttcgtaccagaaacagctggggttacactggagcagattgatgagggcttcaattcgggaataaaggcatggaaaacatcactacccaagaataaggccatcgcttcccagaagcggaacatggcaggtggaaacgtcggagcttaaggaatgcgccgagccatgctcaaatagccgggatatcatatagataaatgtgcagactatggtatatagctaagcactactaggtactatcagtgaggctacctagtttcaaacttgcaacggaactcctcaaatgcatagatgatatggaacaatctacatggagtgcagggaagccaactatcaaacatgtcccctgaaccgcagttatgggatgacgtgtacaaaatctgtaggaaagatctttacaatacgttcagatttctggtctttttgcagcttcattgatcgcaagagcaccaggcacgtgacattctggccctaagggacgcacgcttttcgttctttcccaggacatttttcctacttcgaagaaacggcaagataaaaaatatctgatcagatttaagaagatgtataagtgactataatatggcttacaggtctgcaaaccaaaaccaaaatgcgtggtagttcacggcgttcggggcatggagaaagtgactggacatgcgcgccagtacattttcagttgaagttatatcaatcgaagataccttgttagtcgagccttctaaaacgatattttcttggcgttcaagaatggaaagagcgcttattcatgacagttgaactttgtagaatgagagtacctggcttcacctaccccgacataagcgttatgttatgttgactctgcgcgattgctatctcatttgtcccatcttcggaagcaaacgaaggctttaaattgatttctcttcttcctcttcttcctttctctctttcctctcacatccaccgcggacacttcttcagtcagataaacatacagttctatctggaagcaccaaccacagtgagttgaattcattcaacaggcaaaacacaatgatctgataacaatatcttcttcaagtctacaaagctcagtcaccacgctcatctttgcaattattcctctaccatgtcgttcttcaccaaccaccctcgtgccggccggcatgatgccgagcctgaacaacctcgagttccacgcactcaggtcgctgatttgcccaagccgactcaggtaacccttctgaacatccagaagctgaggccagactctagtcttacagtctggggcaatgaggtccttcatgccttgcgacctttcaagctcgatgcacttgtggacagtgatcttccgaagccccacccaagggacgacgaataccaaaaatggaagttctggacactcgctgtttcgcgctggctgtacaatcaggtggatgcctcgctccaactcaaagtgaaggagcacccaaacgagatcacctacgccgacgaaatgttcagcaccatcaggcggctgagtctgcccaaccagtcgaaattccttgcgcgtgagctgaggaagtgggaggaaatcaaacgtggtagcttcgccacggctgcagactttatcatggcctaccagaaccagttcaaccgcctgaagacagagaaccatgagccctcttgcgactttgcgcttgaccgactcttgaacgagctgcacggagaggtcttgaaggctccctacattcaagaggaggtgaaggatctgggacgccccgtcaactatcagatgttcgtctactactgcaaggtcatggtcaatgaatcccgcaaccccagcatcccggctgctgaggcttccactatgggaggtgacggagaagggcgaggccgaagccgtggacgggatatctcttaccgcagctggagacaaagcaccaaaggacgcggcccggcatgggagtaggtgctttgttgtggactagcccgacctcgcaactaatgaggtcgcgaaagatgggcaccacacctgcactgaatggattggagaattttgtgatgttgtggactggcccgaccttgcaactaatgaggtcgtgaaagatgggcaccacacctgcactgaacggattggagaattttgtgatactacgaaagaaaacccaaaaatccaaaaaaaaagggtcctggctacagtcctggcggcattcagacaggacatagcaatgagatccattgtctccctcatgattcccactccgtaaggtagcaataattagtatttcacgttccctattaggggatttgactagttaagactgcaagagtagaaaagcagaaactccaatctaggtaacgcgcttttgaaagtttgcctaattcaatttcgatgacttgcaggttaggatttagtcaaatatctctgaagtacatacacatacttgttgtggtagagaccccacatgtaggtctaggccctcaccctctggtagcatgtagatagttgtagtgggagctcgcttcctccctctccaatacaactctctcctttctgcttctctgaacctactagtgtagcttcaccaatactacttcatttgcgctatggaatatttgccttaagctatcgtaggagacggtgaagtttgtatcctttctgattatatatctctccctttttgtttcgtccaactagtggtattccgtctgccacaatacgggagagacatatcaaggcactaaggccaaaagaaaacagtcagaatgagagaaaataataaccccgttatcctcgagtatgcactgcggcccaattattgaatcggtcatggtggcttgcatggcagggaatccgatgtggaccacgtctgtttttaacgccccagcaacggcaaacaatcagcaaatactggcagggaaggtgacgctgaggaagccgggtacatggaaggtgctgggggtggtgtgctgctgacgctaagtccaatgcagacgaatacgaggctgaggctgataatgacgctaatgctcaggtgcccaactacgctgacaaagacgcgaatgagattctagagaaacgcttgtacccaaatatttttgacctcgatcaatctgacgataacgagaccccaaatatcaagatggttgaaaaagaacagaaagcgaaatcggtcggacctacaataactttcgtgacgatcaagccaaaattggagtcaaataccaagccaaagccggaggcaaaaagcaagtcggacgcgaagacgaagagcaagccagagacgaaaagtcaagcaaaactggactcaaagcccaagctaagatcagacgcaaagcccaagccaacgcaagaggcgaagaccaaatcagagacgaagagcaaagcaaaaccggacgcaaagccaaggccacaaccgccaaagatcacaactagacgggtggcgaagaccaatgcaaagcaagaagtgaagactaagccaaagccagagacaaaagacaagtcagatacaaagacgaagagcaagccagatccgaaaaccaaaccggagacaaagacaaaggcaaagccagaaacgaagacaaaaatcgagccgaagaccaatccaaagaaaagaatgataatcaatctggagacgataacgaagatccagctgggagcctaaaaagcccaggcacgaataactgcaacagagcggaggaagatgagccggtccctgtctatacccttgtcttgacccctttatttgcgaagtactggagaagctgctcgccttcacattttcaactacaaccaacgcccacatgaagctaacagacctcaacgacgtgcccgatgagacgaggatcaaggatatctgccagagaacacagaccacgagaacggttcgctgaagccaacaagactgactgcccctacaaaggaaggtggtgttaaatgattaaattatggagcaacttggtaggggtagagaggacacattttatagtcttctcgtctcctattacttatgtgctcggcttggtataatttgttgaagggcacatgtgcatcttgatttggtgtctattgaaatctatacttttgttttcactactatttgtaatgaccaccttgatatcattttggataacctagaacgacgagttagggctatattgacataagtgatgttgagccaaggaatattagctgcctactaactaggtaatgatagaatcctccacagggtatcaacacctataggagtcacgcgtgcgtatcaatagaagctagagcaaaaaaaaaaaaagcttacaactagtttggaggacgcacttggaacagaaccaatagttctgcattcgcctgtaggacggcttgagagccatgcaggttcgtctacggagtacgtgagcacattgtgctgtcactgtatctactccgtgtactccgactagtgcgaattgctggggtgttgagaattgctggagtgttggggattcggcgaacgcgcgcgacgcgttccaactcacacgtggataaagtttacgcccctattccatgcatccatcacattcttattaagccctaattatctcgatctgttcacaatctgctttggtctttcagtttcctagtcagaatctttttatctttggcgtaaatttgctaccgacatatgtatgtagggtaggtatattaactactatataacaactgtgttaaagcctactccgtacgcatgctgcaaatgccagactggaatgtgcccaggcccccctaagccctaaacaggaacccttggtgggttctgtgatgaactagtgaccgatagcccgtatttccccccacagtatacatagaagggggatcgcccaggtgttcgtgtgagcctgtccctttttttcgtaaaccacatccttggttcggccttttcgctatgggcaataccaccagcattgccgctggacgtgactgtctagtatccgccgtcggccctgctcatgtcacattccaagatgcgcttctttaccagactaccgcagtcgacccgtacaacttgaatatccccgtcaccccggcggcagtcacctaccctcagtcagcggaggaaatcgctgctgtagttaaatgcgcctctgactatgactacaaggtgcaggcgcgcagtggaggacatagctttggcaactacggtacggctttagtgataatagtacttcagctgcccgcataattaagcagtcgactaactcgtacttggctctaggcctcggaggacaaaatggtgccatcgtagtcgatatgaagcacttctcgcaattctccatggacgagtcgaccttcgtcgcgaccatcggccccggaacaaccctaggcgatctcgacaccgagctttataatgcaggcggcagagcaatggcacacggtatttgtccgaccatccggacaggtggccacctgacggttggtgggttgggcccgacagcgcgccagtggggtctagcgcttgaccacattgaggaagtcgaggtggttttggcgaactcgagtattgtgcgggcgtcgaatacacagaaccaggatattctattcgccgtcaaaggtgccgctgccagctttggaattgtcacggagttcaaggtgcgcacgcaggaggcgcctggcctggccgttcaatattcattcacgttcaatctggggtctcctgcacagaaggcgaagcttgtcaaggactggcaggcatttatagcccaggagaatctctcctggaagttttactcgaatttggtcatcttcgacggccagatcattctcgagggcattttcttcggctcaaaagaggagtacgatgagctcgatctggagaagagattccccaccagcgagccgggtactgtgctagttctgaccgattggctggggatgatcggccatgctctggaagataccattcttaagctggtcggagataccccgacctggttttacgccaagtccctcggattcacccccgacacgctgattcctgattcagctatcgacgacttcttcgattacatccacaagactaatgccggcactttggcctggtttgttaccctcagcttggagggtggtgctatcaactccgtgtctgaagatgccacagcatatggccaccgcgatgtgcttttctggttccaagtgttcgtagtcaacccacttggtccgatctcacagactacgtatgatttcaccaatggcctttacgacgttttggctcaggcagtgccagagagtgcgggacatgcatatctcggatgtccggatcctaaaatgcccgatgcccagcgtgcgtactggcgtagcaaccttccaaggttggaagacctcaagggagacttagatccgaaggacacctttcacaatccgcagggtgttcaggttggtccctaaggcgacgtaggtcgacattctgtgtgtagtatttgatgggatcgacaatgtgtagtggaagaacaccgtctatgagggtcaatatatagtgcatctatattatcttgaatgcgaggtggactttttcggttgcttcctcgagctaattcttgtatatagaatctactataggtgtttctaatattaattgttaatcgcaagatgccatttacctttcaagtatacgtgaggcacccgcaaacgctcaggatatacctaaacagtgaattagaaacagatatcttgagtggttggggaagcaagatacagatttgtgtggtgactatgtggatgatcttgaccaatcctgcaatgctgggttccgtccgctcgttctcggagaacgcaaatataatgggaaagagcagtagacaccttgattcacccaatcctagtccgttcgtcgcattttgccaaggagggacgtgaaagtggtgagcatcaggctggtattgcccggttctggactcgattttccgggaactgtaggacccaggcgttgaatgaactatatacttcctgagcacttgaaacccccaaagtagatgtcgatcgagctgccgttccaaaagcatgcctatggcctgttggaaacggccttggagatcatccactctcccggaaatactcattcctggataaggttcgccaggacggccaggtttctgctgcatggttttttggcggctccgttcttgtatatagggttaagagatgagcctggaagactgaaatggagtttttttcagtgagtcttctgagcctggggtgggtgatacatctgggacttacatggaaagtaaagatgaagagaagggatgatgatcttgattttgatagaatcaacgcaggtacgtgggtaggcaagcactggacttatttacagttggcctttgagtggttctgacctggctttgtcctgaatttcgtatttgcaacttggaatggcctattccctacttgtcgtctggcctattactagaaacgttatacgatgagcttttctatatgtcttcttgttgtagaaggcagaatgggtcttataggctcatactccagacgacgtcttccccctcaagcaccaaaatagtgttttactcgtcaggaattacgaatgcaaaaaagaggctgccagacatagcctaaattcaatatgtaaataacatagcaatagctcgggatattcacacagaagcaaatggggcaaagaagagaagtagccagcacgctcagatgaacaataagcaagaaaggtaagaaaaagtaaagacagtggctagtagaccacaggtgtagagacaagatagttggcgctcatgtacatgcaaggaaaacccgtccatgtgtcgaaggacagaggagggagtgttgggataacgactgtagacttttcagaatgaatgtgagaagggcggatatcaacagcaagggaacagctctgcttgttcccataactccgggataacaccttgacaaatgggtaagaataaaacaagctgtaaagacaaggaaatacattttgtgtggtgtcgaaaggaaagttgggctcttctctaggaagagacagggttagaaaagagagtagggagaaagtgtggtgagtcttatgtgcaaggagggacgaccattgatgtccattacaattcggacttgactaggtcttcgacttcccattgggctctgcgtttgcccatcatctcctcgaggacgtcgagacgctggcgtgtggtacggagggcatggtccatctcacggtcagatatcttctcttcccgaagccgtgcagcaagctcacgctcatcactcgtactggctccagacgacctgcgacttgggtgtggctcgggcgatcggtaaacgttggggaagaccattccgtccataccaacacggtcttctagccagttccagagctctgtttcttcacgtcgccacatctcctcgtatgcagccagtctctggggcaagctgtgaccgggacatccgacttcatgtgaaaccatagacgatggcgacggggatcgcaagaaggccatgtagaacaagatcccgatgattaaaatagcgaagttgctattccatagcggactaagaatgctagtgaagggctccaggagggggcggaccggttcgaatagtccccatgattcttgctttgaggcgttggaatccacagcaaccttcaacgaagcaactgcagtcgactcccgccgtccgctatcacccttcttgcgctttcctttgccccgcccagctccattggcacgcccacggggaacaactccaacctgcagcgctttgacaagctcattaccaaaggttgtttgcccatcaatcgcacctttctcgatgggacctttaagccaactcttgcctgaccactcaatagtacaggtcatgaggaagcgagtttggttgccaggagcccacgtaaagaggtacttggtcatggtagcaaaaacgttgccactgggcacgtcaggtgtttgggtgctcaaagtgacaagaacggccttttcaaggtccaagaagtccatgttctcggtactgatacattttgtctgcttcggaccaatggagccgttgagaggtttgatgtatgagtacttcctggttgggctttccattgtcaagcccttggctgtgccctcgaactgcagctctccacatttctggttttcagcaaggaacttggtcatgaactcgccggacgctgggccgaaaaccaaagagaagaccttgccgagcggggccggaatgatttcatctttgatgactttctcgtattgtccattggcgtcgacgtattcggtgggtgcatgtgtagtcggacctgggaaatcagcaggcgcttccttggaagtgcctttgtcgccgttctttttatcgccattaacatttgtaccggccgctggtagagctgcattcgcggatagactcgaagccttgcggcttaacccttttcgcactggcaatgagtttgcactggcgttggcactgtccccggcctcgaagaagctatcagcattgtccccttcctcgtcctcatcgtatatttcatcttcatcagtgacatcgctttctgactcgctctcctcctccccaaccttctctgtcttatcaccggtgccatgggtcacacgggtcccgtttacagagctcttgatggtggggtggttaatcttccagatattgaccattaggtcgtatgtggactcgcgactgagtaaactgcggaaagtgtgacgggcgtggagtgtttgaatggcaatagcatttgggaacaccatagccgtgctctccttttcgatggcaacaacctcgtcgaagctgatcactagagtcgtgacccatcccaggatgttactggagaaacagatatgtccttctgagatatagatgcggccggcaagaataatctcacgctgcaaagcacagctgtaatcttcgataagataatcatcttcaggtacactccggaataactggtgaaagtcccgattgcgctttttacttgcaaccgcgaagccagtcaaccgaggcacactggaattggcaccaggaacaccaagcgcaacggcattgacgccaatagctccaattgtagaggctgtggccccagacgagccccgatgacgccgggcgagtctgctgcgcacactgccggtgcgtctgaggcccccgctcaggtcgccgtcaatgacactaccactggggggagtttgatcgcccataatcaagccatctttcggaagtgaggtggtagactgaaactccagggcgtcttctgcagagttcggcaatgaaacctccgatggcctttcgtatgctacttgaacagcgcgcgctgcgcgtttgtcttcaattttagcagcttcctcatctctccgggcaacagctgtgtttttgcgcttgtcagcggagctcgctggctttgttatcaccacgccgtcggcagtcgtaattgactcaccgggtcgtgcgtcaatgtccagatggctgaagttaagatctcctgccccaagagtctctacagcagatggtctcccttccaccaccttgcttccattatctgatgggttttcggcctccgcggttgattcggtgagggatttatcagcatcagcaagagcaggctgagaaggtgggcgatttctctgttgagcgttgaggctgttgctgaaggaagtggcggcgttttgcgcaactgaaaacacagaagagaagaagccgctttgctggtttgaagccgcattcttcggcccggaggtcttttcttcaaggggtgttagtgcagatattgagttggacaacttgcttgggccatgagctgcagaagcggaccgcacccggcggtgagagatcatgtttccagaagggctcacggtggtgactccagcagacggaggattttcagactgtagagactcgggcgaatcggtgacatcgttggacaggatttgcgcactgagagggcggtgctcagttggtgttggaggagttagagttgtcgctggcgcaggaatagcagtcttgggtggagtgttcggcatggggctcgcttcaagtgaacgaggtttgttgtccgttagatcagtccgaattggcgcaggcagaggcgggacatcatcaggggctgcctgtgctcgtttcgaggaaagactgctccgccggctagatccgaacagacctcggccgctcttgttgcttccagacttagttgatgaagtctcaacgtcgtcattggtacctttcttgtccgagccaaaagcgcctttgaatcgtcgcccgggtgatgtactgcgtttcttgccatttgggtccgtgggtacatccaatgccatacccgatgttgcgcgtcgggatattctttcactcgggtttgaatctgacccagtggcactgggaccactaacagctgactcggcatcagcattggagccttccgtgtttccagcatctaccgatttggtcttgaacaatggggaggacgaggtgtagaagccggtatgggagttatgtgaggtgagcggcgggggcctaaacaaaaccaacaagatcggcgggttagaagtagtccaagacaatagagaaccagtttctcaacttacccgtccggctctgaatcatcggtcaacagactattgccttcgccctcatgcgcagagctctctgccttcaacgacggggctgcggaggtcccatcccgagacccattggaccgactttcgtgtaggtcgtgttcgaaaaccacaggcggcaccgccggctcgtcgttgtgtttttgtgtcttctttttattctctttccgcctccgacgcgcatcgagtagctttgagaatccactaggaccagccttaggatctgctacttctccgccctgggttttcggtctctcgacagcggaatcctgggatgaccgaccattgctctcgattgcacttgattctgcagatattgtccaggagcggcgcgatctattttcacctttcaagcttgaagacgaagagtcggccataattggaatgtagcggaaggtgtatcgagagggtgcgggcagaccgggaggatcagggggaagttgtcatgaggtgtatgtaatgaagagtttctctctctctcttgttttgcgagagaacttccgtacatagacggggaaacgaaagtaacgaaagagagacaaagtggtgaattgtccgaacatcccctggagctccgcaacttagtcacccgccaagtgaagatggaggcctcagactgaaactgtttctgttcaattggttttatttcgatattcgcattgaaatgatattacttgcaataatttgtagctactgctctacatttcctactgcatatatattctccctatttcccccctccatcaaggtagtagaatggcctgacagtatagctataagcatctagtcctctccgcttctccactgtgtagaatgtggatgtaactggacacatttgctgctttcggtttaactgaatagacagtatttgttctataatatcgatctaggagtattactttcaagggttacctcttacctcgtgtacttcaatttacctcactgtatctggtcccctcgtgttactgtcatctccattcacagtgcataacgtcacttctccaacattccccggataaatcccatcaaaggaatgcacctgatttttctctcttaagtcctgcaggtgaacttattttcgtcatggaagtagctcctttggccctggtaagacctcaacccctcattttcaggataatctgaccggccaggcccacactcatgcccggaacgcagtacttgagactcgcaaggccaacccagtcgctgccagcgaggaacatgatctagctgctggtgaatttgcaaccgctgcacagagcagctccgaccatgaggtgagtcttgattgaggagaagatctgcccccgcccccggctcggcgatgagctaacgcgtcataaggccctacggaccctacgcttgctcgaaactcaccataagaagctcgccgaaatcctccgattccagcatgaacatccatctaacacccctgctgaaccggcatctgctactgccacctcaacattagcgactcagcaaactacagccgagaccgggggcacaaagagcgcagtgagccaggatgcacatctaccaccaagattggtaggcaacgctcgtctgccaagtcgggataaatcctctattgctagtaacttagcatccgcccgaggaatcccatcgcacccccgacgtgggtcgcccgtgtcgcctacacttacatcgcaacatgtcgcggcaaagatgaccgaggcgccacagagggctaaagtcggtgaagcaaggttacgtgacggagcagcaaaaagtcgacaaagtcgtatttctacacccagacaaccatggtctcccccgacacccagtactgaggtggtttcccagcaaagtgtacctcctagtgcagctgaacccggcggatcgaaagataagcccgcaattaccgatgaagcattcaatcgcttctactcggccttcgggggactggtttccaaggtgtctggacctttggcatttgcagggattcaaatggggcctacggatccagtccgcgctgaacagagccgcaagtcctcagccgaggtgaaagtggaccgcgatcatgctgttctagatcggtccatgactgcaggtgagccggacgtgaacaagctcttctctcgagctgcattgcgctcgattcgggacggttctggtgcaggtcctgggaacccagcagaatcattctatgtagtgccaactacgggtgggaccatgtcatacgctgggatcctcacccgagctgacaagcaggcacgcagaaatagcattgaggatggtgacgatgactttgtggatgctcgggagaccccttcatctcctgaaatgcgtcacagtgccagtggttcacgcgtatgggcgggacgccgcggcgcatccgataagctcactgctccacagacacataagacaatggaagagatgcagatggagaatgagaccttgaggaatttgaccgattcactggcgacacgattgcatatgtgggaggtgagcgcgcaatcttcgtcgatggcgcttcagcaatcaatccgaatgatgcaccgccagagcggcggaacacctgattatgcccagccttcaacggccactacctctcctgttgctacgctgactgcgccgccggctgcggctgatactgatgcgcggatcaaagaactggaggagcagatccagcgcagtgagaagaaacttgaaactgccactcacgagaatgacaagcttaaaaatgtccttgggcgttaccgggaccgctgggagaaattgaaagagggtgctaaaactcgaagagcggagggtcgctctggtgacagtcaaagcaacccacctgcaagtggtgctagcaagccgtccgccccctcagtctctccagatcccggtcgaggcccctctaccggtcaagctgactctcgtgctgcgggtgataacccggcatagtccggcaacatccattctcggtggttggaaacggcgtttggtcctctaatgctatcctcttttacaagatatgatatccccctaacacaatttatgaagctttgaatccatttcgttttgatccgaccgatagttcagtagccattcgatttctcgtctaatctcagcctagtggaattagccggaggggatagagtatgtttgatacctaggtgaaatgatgatcagtgtagaatagtatccaaagttacatatccacatcgagaaatacaatacgctcggggtacgttgagcaggacaatgtagagaccatccaagaggatgcgaatgaatatctgagaaatctcaagctttcatttccaaatatgacgcgagatatatacaacgagtgatgcgacacgcacgaagcaactcacacatcggactatatactaagaactaacttcccttcaacgtagacatcacaacgatcactgaacaataaacgtagcattaccacgaatatcctcggagctgctgcccacaaggacagtgaactgaccgggctcaacaacatacttcatccgagtattccagagaccaatatcctcaaccttgataggaatctcaacagtcttagtctccccagccggaataaccaccttcttgaagcccttgagctgacgattaggaacaacaacagtggcaatatcatcctggatgtaggcctgcacaacttccgtaccgtcacgagtagcatgggtattagtcacatcaacgctgacagtgacagtcttctcagatgcagagatcttgctcttgtcgatcttgatatctccatacttgaaggtggaataactcttgccatagccgaaggggtaccacggcgaggcgtcaccgagtacgtacgagtggccgaataccagagtcccgttttcatactcgtggcctacgtcacccatagagcgtccggagttgaggtagtcgtagaagattgggagattgcccacgtagcgggggaagctgacagacagcttgccggatgggttgtagtctccgaagaggacgtcagcaagggcgtttccgccctgttcggatggatagaactgttgcaccagggcagcggttgagttcgagatccaggtgtctgtgatgggcttgccgcttgacaggacgacgattgttggcacgcccgtgtcagcgatggccttgatcagaggtccttgggcgcccacaagggacaaatcgtttgcatcaacgtgttcgccagtcctttgcatgtgttagtattgggacttagatatatcttgaggcaaggtcggttcactcacgttgcgttcagtcctgcccagagttctttctggtcgcgcgaccaggttcctacaaccacgacagcaacgtcggatttctttgccgcctcgattgcctcctcgaagcctgactggtcgttgcttgctcggtcgcatccctgggcataatggacctgggcttcgtcgtcaactgcagccttgataccttcgaggggagtgacgccccggtactgactcctgtagacgacatagtcaccatactatacacctcattaatatccagtctaacaagcgaaataggtttgttgacttacgttcatgagaccgccagccataggcccaatgaccgcaatgttactcgacttcttcagaggcaagatgtcttcgtggttctcaagcagaacgatagactctttatccaagtctcttgcaagttccacagcttcggggctgttgatcagcgtacgccactcgtccttaggtgcagcggggtacgggttctcaaagagacccatttcaaacttggcccgaagcaacctagcgacagcagtgtcaacgaccgcaatatcgagcttgccggactcgacaagctcggggatcttttgaaagttgctgttcgccagttagtgtctatagctgtatcgtttgatttcaacggagcttacaatgaaccgcctcccatctcaacatcggttccagcattcagcagctgcgtggtaaccgcttccatgtcaataggatcgctctcacaaagtttgaagtacgcgcacactctgtcacttccaccggcgtcggtcatgacgaagtactcatatccccattcttctctcaggatctcagtgagagtgtggtagtcagagacggctggaataccatcccatctagaaacggatgttaggatgatggtataagacaaagctgactaggctggacttacgagtggtacgcagccatgatcgaccaagcaccggcatcgacgatagctcgcttgaaaggaggcagccacctatgcaatgattagagaactattcagaccctgggtctagggctggcatacgttgtgcgcaattctctctcaccaccgtgaactgggccagtattgaggccttgctcgggggcgctaaagcctgcgaagtgcttgaccatagctgacacattcttgccctgcactcccttaacgtagctatacccgtattcgccggagaggaaagggtcctcggagaagccttcttcgaccttttccctctgttgttagcttcattgcgctgaatatagtaacatgaagatgaaacccacccgaccaaatcgaagttcacgagcaaggtcaacaacaggagcgaagagctgattaacacccagggctttggcttcttgtgcgattatttctgccattttttcgacaagctgcgcaatatcgtgtcagacctcaaacgcagtatgtatgacagtgcaagtataatatccacttacctctgtgttccaagagcatccgtacgcaatgggcgaattgaagatggtggcattaccaatcaaaaacccgtggatacctggtgcatgacatgtcatgagcttgggatacaatatacctcgagactatattcttgaagcacataccctccgtctgaactagcgcaggaattcctagagttgtgttgtggatgaggtagtcctgggctttcttaatgttgtcggagatccaatcccaagaaacagggtacccgactgcaaagcattagtatttgtgtttctgcgaactgatacaaaaggatctaacagctaaacagggaatttcataccatagaacgagcctgccttcagctccatgttggtgaccaggccggtgtagttgaattcccccgaggtttggttcatccaattcgtaacatcacctgtacaagaattcatcagcaattagaacttccctatggcggtttgagataagccataccttgaatcaactgggccctcttgtcctcgatggtcatccggctcagcaagtccttcactctcttttccactggagcattggcatccttgtaaagaggactgtggctcggtttccccaaagctatggcagcaaagagctgcaggagcaacagcccactggaaagcagattggccaccatgtcgatgagaagataaccacttgttttccaaattcaatggccaagggctgttgtcaactggctatcgtgagattggaaggaagaaaagaaaattgttggggaagctcttgcatataacacccttgcactgcggagacaggtaattcaactagagactggtcgcattgcatgatttaatgatcactaattgaggtaagttttaccattgggcatcggaaatgaaaccgtcttcagcaaagggatcagctagtctccacggctgcagtagtgtcctgcatggcgttgtttcaaccgagctagcactatcaggagacggagcaataccccgccggcactctggaatggtgttctcggattgaggggaaaggcctgctttccggctgaaatgacttaagaagtggagggtaatcaagacatctggggtatctctcctgggcgatggtgcgtgctctcagctttttccacctattagggctgcctctcttcctccgggggagtgagatacacccggaactctggtttgaagaattatgtgtggtaggtgagcaatatacaacgtagataaattaaaagaataagaggctaaaggcaagataggtggctagtaacgctgaaccctcctttgtgggtgaagtatacagggtgaaaagaaatgatacattgacaaaatattaaacatatatccgcagaatgcaatgccaattacaaaaatatgccgaaaggaatctacccggaagaagaacacgaaggggaataatgaaggaaagggggaggtgtataatgcatcagagctagggagctttgggttgattatcgccgagcttccgtctcggcgtcaaaatcaccggtgttgcgacttggctcgggctgtgtctcattctctggtgttggcgtccccgttgcagcgacactgtcggcggttttagtgttttgggctttacgaagggcaccacctagccacgcaagcccgccactccacgagtcactcaagctgcgaagacgagtcacatctgcgttgatcggttgttttggtgtagtatctatttctgtcgcaagagcttgggtcgagcggccagcctccgcgggtctatccgctaggttagtggccgactgaagtcgagcagttgcaagggaaagcgccgcgtcgctattgccttcgagggatggatctgcaaaagcgccgtcgagttgacgccgacgtcccactctgcgccttgtccgatccttgatagggctaccgtcgccacgccggatagaatcagcaatcaccgcagtgaagccaccggaaagtgtgggaagcagaggcccgggggagaaacgatgggagagagagctgcgcaaaccatgtcgcgatggtgtctcaaggagagtgttattgcgaatagcgtggctggcttgatctaagagcgtggtgggggttgaagcacgtcgtacagtactgacgttatcatgggcgcccgctgcttcttcaagaccgggcgcaggagggaaccgcagaaggactgttgaggcttgcgccgcttcgtcttcctgcccaggaggagtaacagggcggatatcagactgtggggtcacgacagcctgatcttcgatgtctgcccatggattggacatgcgagatgggggccgcaatggtgaagtgtaatcaaacgacggagcagacagaggagactcatcggttaaagatccacgaggcgaagagggtgcagcggaaattacacctctaggagtagactgatcatcatcaaccccatcagtgctcaatatggagccccttggggactgtggaacgtcatattgtgcttctatagaaacgcctgatgtcttcggcagttgaggaccaggcgggggcgaatcaattctgtcataataccgttcaccattgagtaaaccaatggacccctcctcgtcttcggatgaaaatgacgactcattgtcggcggcgactctgccgctcgtgatgaagtaaactcccaggaaagtcaacagacatccgccaacaaactttgccgcgcgctgggccgttatcgattcaaaatcacggtaaaggaccgcacttccaatgatgacagcgagagtgaagagaacaaactgcgtcggaatcacctgggtggaatcgaagcgctgcagagcacgattgatgtaacggatttgcatcaatgcactggagacaagaacgaagaccagcagataggtaatagggaatgtaataacatgccataacgtgccagacagaagcgaagagacacctttcgtagaaagagccgtgtatccgcctgttttatacggttagaaacaagaccaagaagaactgagcccaaacactaggaattgctagaaacttaccaaataatgcaacgagcccaacatctatcagaatcgatcgcgatccatactgatggcttgcccacatcaggccgataatcaaggacgtggtcagcccgagatagagctcgaactcccatcgcgtgatgctcgcccagatttcaccaggcccaatttgttcttcggacgatttagcactgagaacaacaacgacggcaccagcaacagagacgatcacgccccagagatcgcgcttgcggaatttttccttgagcaagcatggcgcaataatacaatttgatattaaagccacaacgcccaacggagaaacaatcgacgccggtgcaaagccgtaggccatgaagttgcccatttcgcccacaaccatgagcacgattccgacccaccagtacggagacttgaggtaggatttgcggttgccgtttgcgccatccttacttccagtgctagtggcccgcgagcttgaaccagtgttcctcctttcggtgtcgtcgccatcgtcatcgcgataaggttcgaagtcatcctgctcagagtctcggtattggaccggggatcttcctcttaatccgacgtgcgttccgtttgcaaatcccctgccgcgattcttgtcctgctcccattctcttgctatccgaatatgcgcgtagcgttggatattgagagccaatgagatcaaaacattgccgcataaagccgtaataattccaatcagcgatgaccattcatgcatgtttcccccgtcgttcccatcatgattatgaggagtccctgaggtggagtttgatggcgcgacaaaaatttggtggatagaagaagccgcggatatggatgatctcgacggggagatggccgaagaaagaagaccgggcagcaggcttgctaccagcgatgactgggaagatgccatccgttcgtctgaaatgatgcgatccaaatattcgagtactgtttatcgtacgtcttggcggggaagctcttttggttgtcaagcaccccttacacaccccagctgtccggcgggtacggccgatcaaaacgaacccccagattcgatggtgagcatttgatctcaagtcgcaaacgacagcattgtgttccgagtattccgaatttctcgcgcgaaatttgccacgtcagataaggagagtaatgagtatgagaggtttggggaagcggcagccttacagagcggaggtgcgccgcggagataattgatatgtcagcaccaacccaacctccgggggagccgcttccaaggtcccttgcggtcattggagactacgcggtaatttaacgttccacagtgcagatacgaattcaaacagcgccaatgcgacgtttgcgcgaggtcaaagctcgtgcgattctcttcatggctacatatcattggcggctcgggtgggcagttggggatcgttgggctcttgggggacgtcatggagcagcaaaagaggggacaactcagagcgaatgtaaggagctgggtctggtaagattctggatacttatgaaactacaaactgtactacatattgtatatcgccgaggcagttatatttgagtcgttgcaacccaacgcaacccttctgataccgaaaatcatggtgagtatggtacatctccaagcagatcatcgctttgctttcttcttttccgggccttgttcttcgccatcactcagttccgcgtatatggcctttggttgtgtttccttgtatgccttggtgaatacaggctccttctccgctttgtcggcatatttcaagagcgcttcacgtggatcctcatctcgcatagaactaagtggaatatgctcgaggatgtgtttttcatccggggtattctttgcaaacggtgtctgcatcggcaaatgcggccggcgaggatccctcgagcgaccagaggctgtaaagccaactgtaggatgacgagcagacctggttgccgagctgtaatgcggaactccgttggagccgacaaccactgaatcacctgccaatccctggttcaaatccgtggtgatggcaatttcatcgacgtggcggcgctttggcgccttggacataaccgtcgctgcgcccttcgtggacatggtcgggttgtagaggacgtggttttcagcattggcggagcccgtcataatttggttgagcttttcatgccatagaacagtaatcaatggcgaccccggtgttactggtgtgacgagttctggcttgagagtagcagggttcaagatatgcaggtggccggtttgagagcctgtgatgacattggcagaggaaggagagaactggatgttggatgtcggatagcgggaagatgtcgaggtatgtgtgacggttgtgactggagtcttgaattttctggtatcccaaagcttgatcgtatcatcaccacctctcgtgataacaagccttccatcggaactgatatcaagaccacttgtccatgtatctttgacatgagcgtcccggatctctgcactgggtcttgtgtatgggccctttccactccacatacatagactcccatcgagagccgcacctaccagaatgtcggtgcctccttgtttcggcgagccccatgcgatggcggtcatcttagtccgaccagcggagccagccgcccgtgacttgtgcacgatcacctccctctgtgagcggccgacgctggcatcccagatgcgaatcgtgctgtcggtcccagcagtggcgcataggttaggatcagatgggttccatgcaccacaagtaacctcagacacatgtcctttggtatgatgtaaatctcgtagatacatatcacccttcgcaaattctgtgagtatctcaccatcgcggctgagaattcgtggctgcggtgtggcagtcacagctagaacataacttggggagagcggattgaacgcggcgtagtgcaaggcgtgggtgtcctgggccgccgtcgctttcttggctgaaggatcgacggacttgaaagcgcggagcgtggatggagtcattgacgcaaagtcatgtagtttcagtgtgcaatcggtagaacctgtgattagtcgggcccccgaggggtccacggtcatggtggtcacggcacgttcatgagacttcagaacgagctcatgcgatacgggaaattcatcctcatcatctgaatcgtcggagtcttcatcgctattatcttcgctgtcttttcgctcatcatcgcttcttctttcttctgcgctaggggctgtcgttgcagtgcttagttcagtggtctcgggttttggagccgaaatattggcacgcttggatcggtcgatctgggtctcaacatcaacagatttagcctgcttcccaaagctggagggaaaaaacttgttgaatgcttcctcgtcgaattcatccatgattgagtgtgtgagagactttgcgacagatgaagagagaggcttcgactttgatatgagcttgtttgcagtgtttgcaactcatgactgataagccgaagtgcttggcgcaggcaatctcgcgcagtagcagcgaattttgtactttggatgtatatttatggataaatttagggaaatagctgggcgatgcgccccttagattcgttcgtcactcgattattacaatacagaatggacctagctgagtacaggtctccagtgcaagcactcgggcactgtaccctcggatgattgccagcgcttacaagtatagaccctccacaggaccgccgtcctgcttagtcttcatgatgcgctcacgagcagctcggaaatcgtccatctgcaccctcatgcggcgctctctcaaggccatcaagccagcttcagtacagatagcccggatgtcggcaccagagagatcatccttctggttgatgaactcctcgaggtcaacgtcgtcgccgagagacatcttcgatgtgtgcagagtgaaaatcttcttcttggtgttttctaaaaagaattgtttgttagttaacttcgacgaaacagcagacatcagggtatcacttacggtctggattctcgaagagaatcttacggtcaatacgaccaggtcggatcaaagctggatccagggtttcgatcttgttggtagccatgatgaccttcacatcaccgcgatcatcgaatccatccagctggttcagaagctccagcatggttcgctggatttccctctcaccgccagattgtgactcatatcgcttagtaccgatggcatcaatctcgtcgatgaacacgattgatggagcgtggtcagcagcaactgagaagatctggcgaaccaggcgagggccatcacccagatacttctggatcagctcactaccaacaatgcggaggaaggttgcgctggtctggttggcgacggccttagcaagcagcgtctttccggtacctggggcaccgtaaagaatcacacccttagggggcttgatacccatctcttcatacagctcggggtgtagcaagggcagctccacggattctcgaacttcctggatttgctgctcgagaccaccaatatcggcgtatgattcagtcggtgccttgtccaacttcatcaccgagacaagggggtcagactcctccgtcagtacgccgacgacggacactgatttgtggtgtagaagaatactggcacccggctcgaggagatctttatcaacgaaagacatgatcgagacgtagtactcagggccggtagcacttgagacaatagcatggtcatcatcaatcaactcttccaagttgccgacacccatcgggctgcctcgcatgtcatcaactcgactccgctcgtcggcgttccgatccatcacatccaagtcgccacctcccttggcgggatcctgggttgcccgggccttggccttgcgcattcgttccatattctcgacgtactcttcttctaacagcaggtggtcgtgaacacgctgcatgcgaaggtatcgtagcttgcatcgcgatgtaggatagatatcggggagcttggaggcagtgcttgggccggcagccttgcgcttcttctttccaagacgggtggtaggtggtgggggaggctcgtacttaggcttgtccttctgatgaatgaaagacggtctcagcgctagttgtgtagcagaaacgaattaggaacataccttcttatccttgtcatcgcctccagggcctccagggccgccgcctagattagactgctgttgaccctagtttgaatgttagaaaacaaatcgagatggcctcccaaaggctggcaagattgaggcgctcaccatgtttgtcagccaccgagatggaggcaatcagaatcccttgtatgaatttgcaaatgaatcagagtagggtggatcccgagcctcaaatagtatttgaatgatgggaaaggcgagttgaaagggatgattgtcaatgcagatgtggtggtatcgccggaggtcaggcgctgggcgagctggaagctgttaggtccacacgtgactatttaggcctcaggcgtccactgcgtcattcgcgccttattgccttaacgcctcggcaccttgctttgactccgacattctcgaagacagtcaaagaaatttatattccagcaaggctctataccgagagtatcttacgcaatcgagacttgacagttgcgttcttttctcgaggtctatatctcagacacgtataactggtaacaaggtgacaggtgtttgagctcatcattcatactggattcccgtatagttcccctcctttggtgagattctcgtcttgacttgctttcaattccctagagggtctcgtactctgggagtgatatgatctgaaaccttcctaacaccatcctcctacaattagccccactccgccttcctctccacgacagtttctactctcttgtacagtctttaacaagacggaataggtctacttgtctgcacagtttgcacatacagcggtctcatattccaaaatcttttgtttgacgtctttctaaaacaaacctcgaatcaccatggctagcaaccgtatgcgtcgcattggaaaagagattgcggacattcacgccgacgcccactctcaaatcaaggcagagccatttggcaaccaggacgatgtcacacacctaagggggtcgtttccagggccgcctggcaccccgtatgaaggtggcacgtacaatatcgacatcaaaatccccaccgactaccctttccgaccacctaccatgaagtttgagaccaaagtgtggcatccaaatgtcagcagccaaacggtcagtacccttccacaatatacacttgagcatatttggattctaatggccagtgtagggtgcaatctgcctcgacacgctttccactgcttggtcgccagttctgaccatcaagtccgctctgctttcgctgcaatctttgctcagcacacccgagcccaaagatccccaagatgccgaagtggctaatatgcttctcaagtcacccaaggaatttgagcgtgttgcacgcgactgggcagttgtctacgctggagctcccgctagtgctgacaatggaagcggatcaagcatagatgacacccggcaaggagctggcgaagacagtcttgcgaagtgagccagacttctgccattcaccgcatatagatgctgactatgacctgtagatatgacggatacaacaagaatttgatcgaccgtttctccagcatgggcttcgatgttgatcgtgttgtggctgctttccgacatgtcggggtcgaacgacgaggaggtcaagactacgagttggaagaaaattctatgggtgagattgctgcccgacttctcggtgagtgatgtacatgtatattctggtgtctgggaggggcttggggtagaatgcggcaaaagcacatatggatcaatggattgcattgggtggtttatgatgtcaagtatttgctacattgctttcaatcgatattcaaatcagtaaaacaagaacaaaataaactcccaataactatattgagttgatgttaggtgaagtgaggattggtgttatcgataagcatcagctccgagcaacaacctcctgcggaacaaaccaagtggattatttgctaggctcattgaataattgtcgaatgtttactctcatttctaaaacagccctcattttcctcttttccctactcagaatatctctttggtgatactctaagccgccggccgttatcaccgctatctcacccaggaataaaggtttccagccttccattcttccaacaagtcaagggcaccaacaccatgattgaagacgacatttaccgtgcctcatcccagtaccggctgtggtcatacaccgagccctctctgcaatctctcagagccacgacaaatgccgttgccagcgagcgcgtgcgcgccgctttgcgcagatcgtgcgaagctcatcagtcgactgcaacctccgcggcgggaacaccactaccggaaagcaatatggaagtcaagaataaagatgagaaggacgttgaatgcttgacgccagaggaggagctcgttctcgtgcgctattactgcgagaagacgctagagctgggagagacatacaagccaccaattccgacaatggtccgggtacgttaagctcgacgggacttcactctttccttgaaagtcagtaccaatgaaactgagaatctgacttctctcgtttgcgcatacaggccaccgcgatccaatacctccgccgcttctacctaaccaattcgcccatgacataccatccaaagtcgatcatggcgtgtgcgctcttcgtcgccactaaaaccgataactactatatttcccttcggcaatttgcagatgggatccccggcgacacaacgacagaggacgtcatcgcaccagaattcctgctcatgcagggactccgtttcacttttgatgtacggcatccattccggggacttgaaggcggcgtcctggaactacaagccatcgcacaaggccaaggccagccagccccccatctaccatacgagaccgcagaagatctccaacaaggattgctgtccatcgcacctcctcccgtcccatcgtcctcaatgtcagatcgaatcgctcgtgcccacggcacgactcgtgagctgctgaaatccgctgcgcagatgacggacgcctacttcttgtacacaccatcccaaatctggttttccgccttcttactggcggatcgtcccctagccgagtttttgctggatgtgaaacttggtggccctgtcacagccacaattccagcccccgaaacagacgaaaatggcctggtgaaccctctatacgaaatccgctccaagctgcatcacgtcttgactgaatgctctgcgcttctccaatcctacacacccctctcctccgacccggcgcaaatgaagagcctcaaacgcatcgcaaagaaactgtatcattgtcagaaccccgagaaggtgaatctggctgctgctcagaaacgggaatcaacccaaccatccacagctgttcaaagtgacgctgggattgtcacttcggagagcgaaacagaacgcctagcgaagaagcggaaattggaacaagaacagaaagtccgccaagaagacgacgtttttggtccggagttggtcactcagcggaccaagcagtaatgataatgaaagccgttgaatctaaatacgcattttaatcgtaaacaccagaatggacacagtcctagatccacctgaagacctctctctctctgtgtacagacatgaaagcttgaatgtctcaagtctagcagggggactgacgaattcccgtcatcatcggacagaaacactgcataaggaatcatatgaatctaccctctcgatatccgttcggtgcgatatcaatggttgaaatcaacctttcgtagaccgtccagtagcaagtaaatcctgtagaatgtatacaacaaagccattagtcctgtgctggtacaattagtatcatcattgaccgatactcttccttctacagtccaaaaccaaacaatcgcctcaaacccgaagcccacaggcctctacaaaccataaaccagaaccaaacacaataaaaagcaaaaatacaacattgcatagttattaaaaaggcagagaatctaaaatcccaaccaaaagatccgcaacaaccaaaggcgccgaatccccactgtcgagctcctccttgagaaccgccagttcccacttaatctcaaagcaaatctccttaatagggagcgaaccccaacgaacacgcacgcgattatcatcccggaccccgaactcgccaacctcacccaagaaaccaatctgaatgacccgctcacagagctcctccagccgtgtcgggatctcctctatatcagggctgggggataggcttaggagaacgaagacctggcattgcagcttgtgcgtgaaggcttcgcaggcttgtgtatagatttctaggaagttgtgggggtgtatgcgagctccttccatgctgacgaggtttatgtagactttctggtatgtgagttggttaatttgtgagggcttacttagatctagttgtagctgggagaatgggatgggtgggatgggcgggatgggattgtggtgagatccggttctatttatgtatgtctttttggtgatgacttggatttggttctttgttcaaggagagaagacaatgagggatagtatagccattgttgatgttctttgttgcttggtgcatcgccatggtgcgttctattactgtttggataagaatacctaggtactcagaaagagaagaaaggctttggcaattcgtctctggctgatcctcagagccatgataacaccgttgataggcatgattgtctaggcaggacatggataaatatcggaaggatcaatccagaaagctcaaatcatgtatataagtaggaccatgcaaagcctgagagaatacagcctatacttcaaacggaatcacaagtcatacggatatattttatgtatttcagcgtaactggcatcctttatattcacctcggaagagaggactagatactctatcaaggatgcagacaaagcgaagaacagacggatcgaatcaggggtagtgagttcatgatagcaataaacgcaaaagtcctatcctcaacccaaaatctattcggaaaggagggaaggacaaacgatctaacggacaaaaagaaaataaatgaaaaccttcccaatccaaggaactttttgtcggaatgtccctatttgcgggacccaaacttttagtgccacgatgcgggcatttgtattccttcagttctcgtctagcatttcgtcgtcatcaataggggcaatagggggaaaaaaaacaagttgaacacagagaataaatagagcccttaaacggcaccggcagacaccatcttgttacggaggtagttcttgtagtcaccgatggagccatcccagcggcggatggtcttgtcctcacagaccatgatgtccttggcgatcttgtcgaggagacggaaatcgtgagacacgacgacgacaccaccgctgaaggcgttgatggcatcggccaatgagtcaatggtggggatatcgagaccgttggtaggctcgtccagcagaatcatgttgggggactcgatggcaagcagagcgaagacaatacgagacttctgaccctcagacagggtacccatgagagcagtctggccctcaccgctcagaccgtagcggccgagctgctggcgccagtactggtagtcctgggacttctcggggaagcggtcacggacgaactccagggaagacttggtgagatcaagctgctcagaggagtgctggctgtaaacaccgagcttcaagtgggtgtgacgggagacacggccaccgatggggctgagcttgccggtcatgagacggagcagggtagacttgccgacaccgttggggccgaccagagcggtacgggagtccatgtcgacaccgaggtcgaggtgctcgtacagagtgtcctcccacttaccagagtaagagaagctgacatcgtcgaaggaaagaactgggggaggaagcttctcaacatcggcgaagcggaaggtgaagacacggtcggggatgacgggctggatgaagccatcggcctccatcttgtcgagaatcttctggcgagacttggcttgacgcaccaagttagcgtaggtaccagcggaagcaatgaacttcttgatgtgctggatttcttcctgctgcttggtgtaggccttcatctggttggtctcctgctcgctacgggtcttgtggtacgaatcgtagttaccaccgtagtagaggagcttctggccacgcatgtcgagcatgttggtgcagacaccgttcaggaaatccatggagtgagaaaccaggatcaaggtacgatcccacttcttcaggtactcctccagccacacacaagcttccaagtccaagtgggcagtggggtcatcaagcaagagcagagagggcttgacgaacagggccttggcgagggcaacacgcatacgccaaccacctgacatgtccttggtcatcttgttgatggtgttcttgttaaagccgagaccggtcagaatgagggaagcacgaacgtggaaagtggaaggatccatcttgtccatacgctgtataaaaaagttagtttctgttctggaaaaatcaaggagagcaaaactgggaagatacgtacatcgtacaggtcttcaagaatagggctatcagggccagattcctcaagaacctcctcggccttcttctccatatcttccaactggcgttcagcctcgcgaacgacccaatcgagagcacccaggtcggtcgggggtgcgccctcgttcaggaggtagatatcgacgtgctcgggaacggggaactcgcgggcagcaatggacttgaggatagtggactttccgcaaccgttctcaccgaggagaccatagcgacggccgaaggtcaactcgagggtggaatcggtgaccaggacctttccgtggaacacaagggagcaagaggtgatcttaacgtcgcgagaggcgggcagagatgacagcacaccggtggtgacacgatcggacagaccgtgcttatccatctgggctgtgagcttatcaacggcggactgatccttagtggcaggcgcatcctcgacgattgggtttccgtgggcatcgagttcgaccttggcggccttcttgggcttcttctcgtcggcacgcttggccatgcgggcagccttcgaggcggaaaccatggttgcgggtgggacggtatgaaaaaaggggggttaaaaggagaagtaagggaagacggaagacaaaggtagggagaggagaaaggatgacaatgcaaaaagagattgaagagaaatgcgaaaaggctgagtggatcgcctggcggggcggacagaaatggaggggcgtagagcagtggagttgggtggtttgcccttatcgatagaatgctatcggattgttagagagggaaaaaagagaaagagagattgaaagaagaccgtaccttttttataagtttatttctttttgccaaagaaagtcgagtgagttggcaagttcaaggatttaaatctcaaacaaaaaaaaatccatcagtgggccgtggacttaagtggcttttgattgggagagacgtcaccgcatagaatgcctgaggtgtctatttcgccacttgaatttgtgtgatgcgactggacgataacatgggcctatctgagagataacatgcagctagtatttaaatttgtgtatcccccttagattctgtcactgatcctctccaaaacctctcgttcctcggcagaaagcgataccccatcaggcaccgaaacatcaccgcgttctactatcaaccgccgaggaacatcagtcagactatcctcataatgactaccaacactaggtgtttccttttggctggccttttcagcatcccctacaggtggcgctaggggatgtgacgtccaccagtacagcggatatcgacgctggatattgttgagaaccacagccgcagcctgcatcagcgtgactccaagcaacatgaccgggaacagaaaccagcctatagcaacagtctcagagtgcgtcaccgccaggagagcagtcgcaccagccggcggatgtgtagtattggtaagaagcatgaccgccgtggtaagagcgcaagcaagagcgcccccaagttcagtatacgcttcagcacgagggtccaaggcgaacaacttcgatatcccgacaccgaagaaacaggcgatgacctggctcaggatggcattgcgtggttgcgcgaagggcgactcgatcgcgccgaattcaataactgccgccgcaccctattgtcaaagaatcatcgagtcagccatgggttgttcttattccactctgctctcacacattcaggcccgacacgactcacaaaactgccgataatcgctgtcgcatcacgcgcttcaaaagaaggtacccgttttgtaacagatgcgatcaaagccaccccgcaaaacgctccaagcaacgaccacaaagccaccacgatgttgcctattggcttgggtggtctatcccgatatcccagcatatgagcgatgggtcttggtacgagatgccatcttggcgctggcacgaagggattcagataccgatcaatatcgaaattccaggtcgtcgggtgagatagcgtcacgggtccatgcggggatggtgccatgctggaccggtgcaagaggagaatatgctctgggctccggtaggtttactgatgatttcgcagcagcacctaatcccaagaacatatctcactgtggagttcagccctgctggggatataaagaaagcaaccccatccgtatgtgccggtacctcttaggtgagaaatggctcatgtgtgcggcttaagacgcaacccttcactctttctccgcggatgtcaactcgccgatgtctcccagggttgatgtcaggtccaatttcttgtccactcagcggatttgcatttggtaacataaactactatttgggactagcggcttggcataccgtcattgtcggggaactctgacgatatttcctctttcggattggcatcaatacaacatagatgtactccacaacttcagtcttaatgcgactgacatgtattcattgttctggactatccctgaagtgaaataatggactagactgccacacaaaccagctctctctgctattatgatatacccggtaaataacagagcatccatctatactaaagaagcagtaatttgtcttcagcaatatcaatctacaacaaagagaagaatcaaatctcacccccaacatccctcaagcactcttcctccccaatcaccaacggcaaccccacacaccaagcccgcggatactccatcccccatttcgccatcagcgctctaaggtccgcctcatggccagggacaacattgacaaacacccgatcaacatgcgatcgcggctcagaatgcacagcaccctcgtcctctccgacccggaagaaaacacactcccccggagacgcctgcaccatcccatgtccgcccagctcaacggctagctgggctcgcaccgactctgccgccatagcacaccccacacagcgcacggagacacatacatggtctgggtctgcggcacgggcagcagatttggcggcttgttgcgtggcgcgtgctaggcggtttgtagcggatgggatgaacagggttccggggcctaggagggtggttgtgagtttccagtttgttggggtggggcttgtagaggggatttgggccgttggtggtgtaggtgggtgatcatgatgcttggtttgtggtttggagggtgagatttggcctgagagattttgatttgttgttggtcctgtccaggtggatttgagtagattagtgattggcgagaagagcgattcacgtcttgtctgggttattggtggttggaggggagagaagaataaatcgtccgtatgccaacgtggggtgtcgaattcgtccgagcctttgcttgctctgattgtgagccagtagtgggattggttgtttttagtcaggaagtcgtggacataggccaggaaggaggataaggagggcaatattgagccgttgattgtggcatctgcccaggtgttaaaggaggatggcaggttacatgattcgagggtcaagaggggtccgcagtaggtccatgaggatgaagtgttgagggtaattggatcatctgttggttctttagactcgattgaatatttggctggatatgggaagaactgaaactctggtagcgatttgacgtccatcgcaggtaattctaaggtcaagaatctattcctttgagggctatggaacatttgaaaagctcctggaattaatgtgtacaggatgcccatgacaagaggtacccccttacacctgcaggcagctttccatttctattttagtcctcacctcttgccgctttttggtcattgagtaaaactgagcacgctaagacttcgttttcgccatatatagatccaaaccactacccgtggacatacagttcgctgagccccagtgcaattcattttttatccaacatggtcgatttgaatgaccttcgcccaattttctaggctcatcccattgatacctacccagtatactgtcgggttggttgacttgatacccaggttttgcacgtcgtatcttttcaagctcaaaagatcgacagtgatcgtccactgatctattagaaaatggcgttctatatcatctgcagttcgagggatctttccaccagacgctattcagtaatagaagcttccgaggctagagatgggtttctagttttcacatggaaagtgaacaagggtcagtcctgctgcaattgtctgaaatagtcacggaatccattctagtactgatttatccaatttcctctagcgcttagtgaatactaacctgcgtgagattggacgcatccgctagtcactttagccttgtaagagtctgagcgttgtcaatgcgaacatgactgttttgtattccaaacatatttggtagtgaagtagacaatagttgtatgcgaatcctagtaaggctgggcgttgtaacctactgcaggggttggccgtacgttcatacagatgtatctctagaactgggcacatgcactgcgcttagtctaagcgacttgctagcgttgaggtttgacccctttttcaatcattcatggatatcccaatttatgctcgggtataatgtcctatgttacttgacgttgttattgatccccccgcaattttattgcgttttatacaccattttagggtttaaatcgatatttattgctcataaacatgtcctcggggtttctctacgatcaaatacaagcgatcggtcttattgagactgcctgctcgagtcacactactacctaatgtcttccaccttttcagcaccgtcaactgtcacacaaactgtctttcagacagtcacaactcccttcatacaagcaagcagctgcttgtctatatatgacctgatcaccctgtctatactcaggccagctggtggttcctccacgatctcccctgtcgctttcttgatctcggatgctgccaatcctcaattttccgcttgccagcccaacggctggaatgacggtgacgccgcgagccaattccatttcagtccagccgtatgtcccagcgactggacatactatgaaatcagacgcacatcctccaaagctgggaaaggaaacttagatccctattccacggcctactgctgtgctaggtttgtacataaacgtccacgattagtgatatattgtaaacatacctatcactgatcattcactccttttagcggttatcaactatggaatacactcacgtctttcctcacgcctttctatgtcaccagcctcccgacaccctgttaccaatacgtccatgccggctcgacctcaatcacagtatcaatgtcgccatccggcacggagacaacaaagatctttacagaaggatatatagctcacgcagcatgggggatctcttgggcggcatcggacacggcgagcatgtccccagcattaccattgcttgattcggagcaatacattccgacctgggtgccgggacagagcgtcacagctccttcggaaccaaagtctcagaatgactcggcacttacggctttgggatatcttctcatggtgggccttccgcttattggcgtcgcgatcattgcatgtgccgtttggtgttgtttcacgatccgacgggcgaggcgtcgagaggcgccccaattggagcagtggcgattggagcatccgactagtatattcagaactccgcagtagactttgaaaggcttcgtttatggaataatagcagttcggttcagttcatcttcttttccttcctccttccttcatgctcaataaatatttgtctggccaaatcccgtgctgatacctacccagtgagcccagctaagcctaagcatcgtaaaagcggcggcagtttggggcccgtagacagaatacgttgtggatatatatttacagcgaactaaaacatctagactttcagctgctggaatggttgcctttatgtgacaacgctaattattggtctagcaaaggacttcatctaagacttcaatttatattgccttttatcaagtatatcataatcattatttgcatcgacggatcttacaaacccagcttagacgtccaaggtacgtccagagcgagaactctcacgagccaactcgatcaaacgaatgacctcgcgagcctctacaccactagcagggagttcaccctcgccattaagagcgcggacaagcttgcggtagtactcggtgtaggtggggggctccacggtgggaaccacctccttgacgggcttgccgttctggatagtagtcaaagcaccgtaacgctcgctgggctcacgtccgtaacccttatcctggggcatgatgccggccttgagctgatcttcttggatatcgaggtggtactatacaattggtcagtttttgattttcattatatcgcagtaatcagcgcaagtagatgatgctcttaccttcttgaagctacccttgtcaccgcgcacccagaagcgcagctgctcgtcctcggggctgaccacggtcgccttggcggtaaccatagtgccgttggcatagtgcagcagaacggtgaaggagtcctcgtatgaagaggtgttggacgcccgagcggagccaatgaaaccggtcacccgtgcgggtaggccaagcagatgcacggcctgatcgaggaggtgggttccaaggtcatagactgctgagccaccggggatgaccttgttcttccacttgtgagagtcggaggcgggttcctcaggacggtggcggtcgaagtgggtctcatactcggagatgcggcccagagagccgttcttaacgagcttggagagggtcacgaagtcggcatcccagcggcgatctagggcagggattagtatgtgacttttagtaagctaggcggcgggacatactctggaacacggcaagctgtttgttgttgctcttcgcaatggcgatgaggtcatcggcttcctgggtagtgggggtgaagggcttctcgcagacgactgacaaatcccacgttagttcatctatgccaattatcttggacttctagacacttagcacttaccgtgctttccagcctccagcgccagcttgaccagcgcgaagtgagaatcgggggcagtagtgatgatcaccacgtcaattgcggggtcctggaccatctcctcagcagtgcggaaagatttcacaccggggtggtccttctcggcatcatcatcctgcttcggcgtgcgctggacaatggcatagagcttgagctcgggaacctccttcacgaagggaatgtggaagatctttgcgctgaagccgtagccgacaataccgacattgtaagtcttggtagccatgatgagaatacgtgagaattaatttgaaggtaaagaatcaggagagagaaactatttttatatgtccccggaaatcatttggcggggggaacgtgggaaggtcctggcgacggcaactttggctcaggtggggttccaaaccccaaaggccgagtcgggttcccgaagtggcaatgttcgacttttgctatatttcccggagtactctgggcctgattgataatataggaatgttccaaggttcttcttatatttgacatcttggcttctgccgctctacacttccacttgcgtcattggccattcgccatctatccctgcactcccacacacctcgtaacctcgatagcatcctgtcaaattgcagttaacgacactggaagactccttttttcggatggtccaaacctacctccaatccctcgggctggcatagctgactctgatacaccaagttcgggttcccgacaaaatcgaaagtgggcacgtcatctttacccacaaaggactctaccgtgcgctcggccatcccggtagtgttgtatgacttggaaggtccactcttggctgcttcacgtttctgttctaccgtgctgcggacgtattccagatatggcgggttgcccgggtaaatgacattgtcagcagcgagcactgaacccggcacaatagccccgaggtgctcacacagcttgaggtcagtggtgtacgctggtttgtaatgatcgatgaaaagaagttccactttcttcacctcgcccgaggtgagtagtttgtgtagcgacaagtcgcttcgactgacgatgatactcacaaagtctcgcaatccggctagttcgatgagcatattggcaattgcggcgaactctgggttcagctccagactcaagtagcgttcgccaccgtttcgacggactgcctcaccgaacaggattgccgagtagcccacgtagcagccgagctcgatcatggtctttggcttgagttcatcgataagtttggtgacgactttgcccttttcagcgccaacattcataaaatggtagtctttctcaaactcgtgaatcagatcgatcactttttggggatgtccccggatgtcatccagatttggttgcccatagatgtaatgtaggggcttcagctccttgctagtatcgttctagagtatgatttagcgtgattcctcacagtcaaatggtcagaatgcaaccaattcctaccgagggttcttgtagagacatgacgttagtttctaatagagcaagagaagctgataaatgattcaagggattctatgctgacgtgcgaagttataaacgtcatctcgcctcggggatacctcatggagtaagcccgagtagatacccgtggacagccctggggtaaataaaatccgagtccaaccatgcaccattcaccaattatggcgttgatcactatcccgagcctcaaaacacatagatctcggagatatcgctctaagtaattagtaccgagagcactgatacccggaaacctgatcccatgtggtaatcgccggacgttcttcccagccctggaggttagatccgagaacaccgttaaatgcggagaaatttacactgagccatggagatcttcatcttctccagatagatcgagacgtcgactatgtactccgtataagtgtttaatcttgaaagtgtatcgtcacaccgaactagatctgcaggccaagcccctcattagtctccagccccctccaactcacatttccattccctgtcagcgacgatgccctccagggctatactctaggttagccttgtgagtgtgttgttcccaatatttaaattcgaatgagcggatctatctgcttgttgcgatgaaacctagactcagcatgtcggtcaaatccggcaatgcgtccgtctcatcggggactttatcacgagtgttctggcatatccttcgaatatgcctttcattctcgttgttgtttgtcgataatgctattctcgtggtcgcgggtttcctagcttatctccggcaagctaatcgacgccgagaaacacaacggaatgtgcacttttaccccaagacagtccttatcacgggcataggcacggtccacggcctgactctggcaaggtcatgggctgtagaaggtcaccgcgtggttggggccgatgttactgacctagacttgcccgtgcgctccggcgggagcatgtccaaggccctagtcgcattctaccgaattcccaaggaccattacatcccccggctactcgacgttatccaccgcgaaaaggtcgacctgtggattccacgctcgcccaaggcatcctccattgaagatgcgacggcccggcaggtcgttgagagtcgcactagttgcaagtgtatcacctttgacaccgaggtggcggcttgtttcgtccatcctgattccttcaggcagtatgtggtcggcagaggtcttcctgtgcttgagtaccacagggttcaatcgtgtgactctgtgcacaagatcttgcaccggtcgccctccaaaacctaccagatctcccgagcgaccccatctgcgaatgagaaggttatgctcttgccgaggcgcacactgagcaagacatacacggtgatcagcgagatccagatctccaaagatcgaccctggattctgcagcaacaatctcgccttggtgagctatttgcagacttactgattgtgcgtggccaggttcaagccacgaacgttcggctttcggattctggttcgtctacatggggtgcctcgcgtctagatgagtctttggccgcttcggtccataaactcatgcagaaattggcagctacaggtggtgttcgcttgacgggccatctctctgtccgacttatggtcgatgaagagtttgatacgcattctgtccggcacactatctacatcgccggctgtacacctggtgccagagctgtggataatctgctgtataatgtaccttgccccattgcaggttatctatctatgttcccttccaatccagccgacgcagccaaagtcgcagcaacactatcatcaacccgtccaatgccaacatttacccgagccgccattcttcccgctgctttcatgcagttttcgttatttcactttgcactcacaactcttgaagttgcagaggcagaactagtgaggctgctgttctggaaagaccccctgttctcttttcttgatccgtttccctggtggtgggaagtacatgtctatcagccattgcgagagatctgggtgttgatgaaacaaacacgagaggcgggattgggttgatttccctttatgttagtatgagtatacgagaaatgagacgatgtaaattgacaggcatacgccaagaagagtgtggcggagttcccgaaatagtaacgggctgtcgcctgggcagcggattgtggaggacatacgtatgctcggtggaaacaagaggcaggataaggcagagaaacaaatcgatcgtcggatttaatattaatattgaactctcaatttacatatctctgctgtcctgattcaaataatcgcagaggcgcgacattgcgacggagaattaatcaaaacaaaacaaaccgacaacttttctccacggagcctcagcgtggccaagaccctcccaggtctcattcttcaggtctcgactctgttcttgtctcatctctcacctttcgtctgccgtatgacttcacgataaactacacactccgagaccaacccctcccttccctccgggccaatacaaaaagcgcaacacccttgcagcgcccctacatacaagatgaagtttcaaatgccgtcaggcggaagcctcggacggacgaaaaatatactacatttcatacaaggattcaccatcttcctcgcatgggccttaaccatcgctatctggaccaaaggagacggcatcgatggacgcacaggctggtactggggtctggtgagttttctgttcctgagtttctgatatgaaaaagctctcttttattctgacgtacgaccgaatggcagtgctggttgagcattcccggcctggtctacctggtggcagtgccgatgtggccacgagcccgacgattcggtaacgtctatgccttcgccagtgtcgacatcctctattcgattctctggctcagtgcttggatctgtcttgcttcctatgtcgcccaaggaaagtccaagggttcgagcagtgacaacgacaagtccaactccgattccaagtccaccgccaggagagccaacgccgacagtgacagtgacaagagcaccaagaccggatgcgataactgggcctacggaagcgcttccaagtgtaagctgagcgaggcgactacaattatcggcgttttcatcttgtacgtgaaatcccctctaactgcgagatccagcgattcctcgaatgaaactaacagacaaaaagcgtcctcttcgccatcaccgcctggatgtccttccgcaacgtgatgcacttccgccgcaccggcaccctccccgacgccgtctccgatcccactttcgccgcgcagagcaaagccgccttctcgtcgaacccagcccacgacttcgaggaggatgacgacgacatgcgctccggccgaggcggcggcatgggcgcctcctcccgcggcgatcgggacgaggactatgcccttctgcaccagagtgaggtggatgacctgagcaacgcacacggccggaccgcgatgcaaggctcctacgaccccaccgctcccgctcccgggggcatcctccacgattataacaacacctcctacggtggtgcgcatggccagcactacacggagccgtctacccagtacaatccgtcggattacactccgtctgagtacactgctcccactgggtttggcggctcatcggtgagtggctacggaagacggcccagttgagtaaatgatgttaccggtgtacatggagacattgcttagtgaaatacccggaggatggatgagtcgtcttacttttttgcgccttggatattgaccatggaagcggtgttgggcgcatcgctgtttactctgggctgatgcccttgtctttaccatgtttttcgagggtcttttaaccctgggatgatgattgtatgtcctgtttttgtttcattggatctagcaaaatatagatgtattgcattgaaaaatgaagtgccccgacttgctttgtaggttagaatgcctcggttgactaccaacatatatagatgatatcctgaaggctgagatcttgtcaatctcttttggggagcttggagccaggctacactcacctctttaccattgtatcatgttaattgccttcaatgttctcaccttgaatgttgctcatagaaggaaaagatataactagatagcaaaaggaactagtattctgccaccgctttccatatcagtgagtttatggacagcttgccctcttgccatcatcatctcttgacaagaacaactccggattttgacctcaaagtgaattttgtcttgtgggacagctaacagtacgtcttgaactgtacctcgtatgaatttacccatcctcccatcaaaccttgccattccatcccctaaacaccgcctagtcacaccgcagcgcatatactagcacacatactaacaatctcaagaagcacaccgaccatacaaaccaaaccacgagacctacagtctccccagccccaaaaatggccagtgaaatcgacatctacaaccaatacccattgtacatggaccccagcaccaaagcgctctcactcccaccctcatccgcccaaacaccctcccaagcagccgcaatcaacaccgaactggaagaactgaaccaactacaccgcgccctaatcagcctcgacccacccaacatcccacccgcgcccctccccttaaaccccaagcgcagcgcgcaaatcagcaaactccgcgacagcgccaacgccgcccaccgcaaatccaactacgaagaggcaatcaagctgtactcttacgccatcgatatggccctcagccggccgggctgggaacctgtgggcgttgcgcgggaggagttggcgggtctttatgcgaaccgcgcgcaggcgcacatggctctgcaggcctggcccgaggcgctggttgatgccaagtctagtgtcgactcgaagcccattgggaatgttaaggcttggtggcggattgctaaatgtcttgcggagatgagtcgctatgaggaggcgcgcaagttcttgcataaggcgcttgatattgaagggaaggagtcggagggtgggaaggagttgttcgccttgctgggggaggttgatagggctttgttgcggggattgtcggcctagagttgctctcttcctgtgttttgtttctgcgcagctgcgcttttctttgtttctgcatgttgactagacgttttgtcgaggcttttatggtttatttggttctcactgcatgattccctccctgttgggatgtttcgaggcgtttatgcgttgttgacgaggtttacattgatattgtatatctctggatttacgtgctttcctatcaaaagacattgcaacatacggctttcctccttctcattttctctttcttctttagagtgagcgtagttcaaacaggcgcgaaatatcgacgagaaagcgaaaaagtggccccaatggctaacatctacgctctgtagccagataccataattgcccgcaattacttggtagactaaagccgtacaagtcgtaaagtagaccaagaattaataatccatctcgtttgctaaacagctgtaatttatatacaaaaagtggagcggagaacataaacaacccaaacgttagatctcatcaaatcaaaccaacacgcttgacccatcactctccttgcaggcacaagcgcccgcgttagcagcaacctgtgtcggtgtgcgcgcaaagctcggaggcacatcaagaactgggctgcggtcaaagaagttgcgcgggcgcagaagaagtgtcatcggctccgcaggcatgatagggtagtcctctggcgacgggaagtgcgtcagaccgaaagtgtgccagagaacgacatcggtgttatcaatagagcaactgggaccagcagcttcgatccacgcgggcagaccctccgagggctcgccggatgtctgtgggacgtggcggccagctggatggacttgatcgtcgtcatctgaagaaccgggtcagttaatgaacacgacatagaaaagagaaatgataaaactcacatttagtaacatgaacggcgtggcgcgcgaatcctgctcgcttccagaccagtccgccggccttggggagcaggggaggaacatcacggctgactagcttgtagctgacgggcttcttgctgtatgggttgagcttgttggtattcgccatgtcccaggtacggctggtagatccgtcatagtcggacatggcctcgagcggcgtggagaactttgtctttttggcatagaaggcgttgccgtacttgttctcggggctgccaacttcaccgggtccttgaactgcatctacctggaagactgtattgctcggcccgtcgatgttcgggtctacacgaagacagaacaggtgctggtggttgtgggcgttgacgccggggtacacctcggttccccagcccttggtattctcgcctgggttcatggcgtaggtgttgaggatgccggtcagcttgatctcgagctggactgtgccgtcctggtggaagatccagtacacgcagtactcgtagtttgccgcggtgaagatctgcgaaatgatgagctttcggccgcgggttacgaccatcgactcgtcacggaaatcggtgtgcttgaataggatgccggcgtcttcttcgtggatgcagattgcgttcttgatgattgtgctagcgccagctcggttcacgaatgctgcgtccatgtagtggattgcgcccttgcagtcgcatccgagtgtcaagctgttggtcatgtatccgccgccgtactcgcctaggtcgaatgcgtgcttgcgctggtggggatgttccgggttgccgtatggcacgaccatctcggccagagaaagacgccagaaaacagggcgcacattgcccttgtcgttgaaggtgatgttgttcaggacaatgccttcacggtagttgaagccgacgtggatgttccaattctgccattcgattgttcgtcccttgacctcgaaggacacaccctctggctgggtgatgtggattggcttgagatcggtccggtatccaccttcttgctcgactgcggccgggtggtagttgtttggagcggccttgctaactggtctccgcacaggcggcacatcaatgtggatgatctgcttggtttcggagttgtagatgggacagaagtccaagggataggtgtactgagagtcgtccgggtgagggcggtagtacatgagggcttgctgaagacgaacgccggtcccgaaacgctcatcatatccaattgtccatgctaggatgccatttgatcagtattaatcttcgataaacgaggaaagttcgtccacttacggtcacagtatactttgtgcatatcctccttgggaattccaataataccacattgctcaataaccttagcatccttgcggacaatatgttcaacctcctgcaaatcctccatggtgatgagaggctgaacattcggtgtgtgctgccacttgatgatcttcctctggtccaggtcaaccacaccatcgtagatcttgccgccaggcgcaatggcaacaatatcagcggctcgggcaggacgaggcgcattctccggatcagccacccaggccatcatctgagccttgcggggctcatatagagtgaccgcattgaagttgagcgagccatgttctttgcggataatactaacagcagcatcaatttccactgtagaaagaggatcaagtggatgaggtggcggcgcagtagcgctgacttggtgagtcaattgttgtagtcggtcgagcaccatactgtgctagaagtatatagaaggagatgacttcaatatgatgaggttaaagcgccaagtcaggtaagtagtcgctagagagtcaaatgcaatagactcacttgattctccctcatgcccgggcctgcggactatttaacaagcaagaggtatctcgatatgtccctagccctgcaggtatacctcgatccgattagataaagcctatttgcggaggccggatccaatgacctgattggggttagcgtggtatctccaaccccaaaacggcaaagagatgcttgtctgcagcttgatgttggtataatctgtgttattcatgtcgtttgtcacatcgcggggtagaatcagagatgtcgcatgacaatgctcaattgagaacgtgtgcttaagctcaatggcggtctggagctgcgggccttgccttgtcatccgagaggatatgtagatacgtcgagcagatcccataagatgatacggagtagaccggaacaacctaggagctcttggatttacaaagccaggccaaattgaccgaacagaaaccagaattcctatacataggacacagacaggtccgatctagctacaacaagaaaggaagaaagaaaaagcgtctagatcacaagaacgaaaggcacgaggccatactagagcctgtaaacgcctcgtaaatggattcaaaaccaaccatatcaaacgccaggcaccctcctgcccaacaccgtcgtccagacgcaagaactcggcacaggcaacgaagcctacgcaaagccataagcgtgaagacaatgccgaatatcgaaggaaaagaacacgattctcgtgtctatgtacatacatcatatcatatcaaccccaggtgcttcggggactgtgcctcatacccggcccatttgataggctccgggagtcggggcattgtagccagctccgtagtgctgaggtgtgtgggcgccagccccgtgagacccagtattgggagtgctgggggtgccgcccgagtaaatggtcgcgccattaaggttgggcgtttgctgagccatgttgtaggccactgcaggcatttgtccgttgagaccccagatttggccagaatatttgctgtcgtcaattgcccctccgaaaatgagttggcgcgtcttccagtagatctcgccggtgactagggagtctgagccagcctggtgagcgattccgacgcgcttcacgccaagttcatcggcaatgtcttgcaaaccagatttctggcctagattggtgagaatctgggctgcagcctgactgagaggggaaccgttgacggcttggttgcgaccggcgtgcttcatgaggtatttgatgtcgtaaagtgacgggaagaagatggtaagaagcttgtggaactcctcttcgttttctggaagctgggagcagagcatgatcttcatcaagtagccaaagtcgtacccggagtggaaagacacccagtgaacgtcatccagtagcaccaatccagagctaatcaaaagagcaccgaattcgaaaggatcaatgccgttcttttcatgcatggcgaagtcaattccagatttggcaagcatggctgttgactcctgggcgtacatgtcgccttcaagtgaaaatcggaagttgaactgccatgtgcagggagcgggcacaccatacgcttgtccattggcatcagtgcctgaggctggggggacctctccttcgtcattgaataacgtgatgcctagttgtatcatcttcagaagatcaacattgcatcggagggtctgataatggtaatcggctttgttcgaaaaagaccctatcggccgagcaacaataccagggaactcggtgtcctaggccctagtcagtaaacgttactcatagaagatttccgtttcgcacggagacaccacatagttggtgcttaccatgctgatgtaagggtacttgtcgaccaactgcctcagcaccgccatctcatgggccaggttgtgcttccagacatctctaattcttgacttcactgcaccgccctttgcttcgagcgctaaccgaccgtcgtgaccctggtgtagttgctgttgttgcatttgcgcaccgcgcgcgaatcccatctgtgccgcatgactagccagaccggtgccgccgccatcacctgcaccagctcccgggaagccggctaccgccataccatttgcaattccgccggatagtgtaaaagggttgatgttggtattcggattgcccgcgaaaccaggatgaccaagcgaagggggagggagtgtgtttccggactgtgcgtgtgcgggatgttgagattgaaggtgagcttgttgtatgttgtatggagcgtttaagccagatggcgcatatctgccgacgggaggtggcattttgttgtctcgaggatgcgcatggatgaagtgacagtttcgtccctcgaaggcgggagagctacttggtctaccgtattcggctagcgcgggtaattgccaagcacacctcttttcctcaacttcggctcctcactgtgtcactttgcggttgattgcggactaagggaccaagttacagcccttcacatcttgtttcactttatttccgtctctcagtcataacttactaccggacaattcccacaatgtccgcccgcaaccccaccggtttcgacatcgcccagttcaaggccgcggcctccccatcctccgtctgggccaagcgggatccatgggctcgcaagtacgtcaagtgatgccgatatcatgccaattgtgctaggcactaatgtttttacagtgaggcgtggcgctacaccggccccttcagcagagccgcccgcttcaagggtctcttccccggcttcggtatcgcgactgtcgctttcgctgcctactgcacatacgagcacttcttcatgaaggatgatcaccaccacggcgatgctcaccacggtgacggtcaccactaaaaggttgtctctggagaccaattgagaatgccgccgaccgatggatcatcgagcggaggacgtataccccaggcgacaaaaaagagtcgtctcgcctccacgataaccacagcctttggattatagagcctacagctttgccgggtccgggagcttttgtcgtgtcagggcggatatgcagcttctcatggctcatagggagcgtagcttccagatggcgctttgggtttgatttgtcgaatgtacatagcttttgttccactactacaaccagatatttctttattgttcgatcgacgactccactggcttgccgtgctatgttatgagctggttatcaaggtagggttggctttaagcttctataaacacgtaatatcattatcgacatgaacccccactatacatgttcgggacgttcaactttttgttttatgcggattactcctcaaataccagtgagataccatcatcaccggcagtgacaatacgttttccatccaagccctgcacaaagcccatgatgccacctgcttgctcgccctcgtcattttccgtggcacccatgtgtcccttccactcccgcatcaatccttgagaagcagcggccgtgccaccacgtgcgtcccaacgtcggaccacaccgtctagaccgacagacgtgagcatccaagagcggttctggtgggctgcggaagcattggcaagggggcctgagacacttgcgccgagtttcttgctgctaggcaagaattcaaccttgacaacagcgcttccttcgtgggcatccctgatatgccgacggaccgcaaaacgatgagccgcatcgtacataacgaccgaaccatccacagacccagcagcaagaagggtgaacggagcctgggagaatgagagtgactcaatgttgtctgtttgagtctgtaatgctgccatgatagtgcctgcagcggtggagccggctgcctgggcgggtgcgcctttgcccttacccttggctgccggggcacttgctgtgacccgaggaaggccgacaactctaatgttgccctcagcaccaccaactgcagcaataccgccgctgggggagatggcaatggtgtaaagaccaccctcaacggcgaagcgctgatcctccgcattcaatccaaggatggcgttggtacctggggagtactcgatgccagcggcggcagcagctccaaagacgtcgtaaacaaagaagctggcgtcctcagaaacagtcgccagcagattgccatcaggcgtccatgcgcctgcagtgcatgattcggtgtgggagaagaaggtctggatgatagagataggttgcccggggtcggtgtgatcgatacggaagacccacgcactgccgtcattggcaccgatggctataacattttgcgtcgcttcatttccttgctggtaggggcacacggccatccaattgatctcttccacttcctggacctcgccaacgaactcccatgcaagtcctgtcttctgaggtgtggtatcccgataagctcgcagcttgccatccagaccagccgtaatggcatattctcctgccggctcagtgaaagccacggcattcacggtgtcagtgtgtccgtcgagcttggccagaggcatgagagactcgcgctctttgggctgagggtttgactcatagctcgatgggagcacaggacgcggtgcgggggtcgagtcaaagatgtagcctgtgtcatcgccggaacccgtcatgacaatgttgttgtgaaccgggtgctgcgcaacacagaagacagagtctgagtgggagtcgaagtgtgccgatgagtcgttttggaaggtgatctcatcttcgatggtcatgttttcgtcgtcgtattctccctctccatccgacatatggtgatcctcatcacgatcaaagatctcttcggcatcatcggcctggatatactcctctgcattctcacgatgcgggtcggttgaagacatttttatttttcaatgggtcggagatgggggctgaacgatatgatgctgaaaagagtggtttatgaacagtcactctttatatgatctgttcctaaacaatattgaagcaaagaagcaggttggtaaggcaactcaaaatgccctcgatcttttttcttacctccccgcttagaaatccaccaccccgcggcagattatgctctgtcccttaccgccttagtgaccgctttggtatcagcgcgaaacgcgaaatagcatggcgttttctgcgaatatatggccacagtcctggttgtagattgtttaattgcaaattgcattgattcttttgatctatcctggtgtttcaaagcgtgaagaagctatggaccccttgcaggagcctttcccatgcgagcaatgtgacaaggtattcgggcataaacaccatcggaagcgccatatcctcctaactcatccgcaattcaatattacttgtgaccggtgtggcacagctctcacgcagcaatgctatgaccggggacactccttttcgaaaaaggtttaatgccgcttttgtccaaagtcctatagtcgaaggtatatcatagtctctacgttggggtcactttcctattcatgcctatctgaccagacaatcgatgatttcgacatgcccagacatcttcgtcccagacttacatgtcaatgagactaagattggtagtaaataatactatcaaacaagctacaatatttaaaaaagaatgaactagctaccgatggacctacatactcttctgataacagcagatgagatgccttgtttatcacgtatttacatatatacttctagttcaagccaacaatggttatcggtttccaagtttcccagaccaagttctaatcaaagctacccccgacatttttagatcttgctaccagcctttctccgtgcctccttctcttggtcacggatcaaccgacgaagaatcttaccactcgggctcttgggaatggcatccacaaatctgatacctcccttcaaccacttgtgacgagccttgtggtcctcaacatacttcacgagagcctgggagacagattcgtccgatcctgcgctggcggacttcacaacaatggccttgggtacttctcctgcacgatcatccggaatagcgatgacagcacagtccgagacatcggggtgggcgaggatatgggcttcgagttcggcaggcgcgacttgcagaccctaggaatgacgtattagattgcgaatattcccatcagccgatgcgatcacgaaccttgaccttgatcaactccttgatccgatcgacaataaacacgtgctcgatgcccttcgggcttctacggatgacagcctcgtctcccgtacgcatccatccgtccacaaatgtctctgcggtggctttttcgttgttcaaatagcccaggacgacgcttgggcttcggaccaccaattcgcccggtgagtcgtacgttgtgatttccttgttttcaggcgtcacaattcgtgcctcgactccagggagcaaagcgccggatgaacctagccagatatcgtgcgggtgggtcgagcttacgaccgtgcatgtctctgtcagacctgtgcgcaaatctgtcagtgctgcgcaggttagaagcatcgattaccacgtaccgtatccttggcggatcaaaatgttcgggtagagtttgaggaaatcggcagctgtctccatacccaggggtgccgctcccgtgaacagagacgtcacggaactcaggtcatacttggagcacacgtcttgagtgcccagcatgtgaatgatgatcggaggtacctaagtccttgcggttagtattcgacggccccttctcatcgggaaagacatgctcaccaggaacagcgcactgatcttgtactgttggatggcgttcaggtaggatttcaattcgaatttggggagaacgattgtttggtcgcctcggtatgccccagcatggccaatgaccacaagagcatagatatggctctgcggaaggagaccaagagcaacctcagtactcgcaggctttgtgcccccaccatcccggtagttctgctcaaacgccttgatctgaagggtattggcgatcacgttgcggtgtgagatcatgactcctttctgttttgcagcacattgttagcgaaagtgacattcaaattgtcaggacactgcttaccggcaatccagacgttccacttgagtagcacacaaatgctgttcgccgggcaccttcacccgcgctccatcgcaattcatccactggcgggagagacttcccagcctgggtcagttcggaaacggacttgtatcctgctggaggcttgactccgccaagaagctgctcaggtacatcgagtaagtagattctgttcttcgggagaccagctttggctgcagcttccagtgagatggagaggagaggaacacaagtcacaagggccttggccttggaatcaagcagctgatgcgtcagctcggcggcggagtatgatgcgttggcgggagtgagaacaccgcccagtctgtgaacggcccagaataggggtaaggaatcgatctaatcgggaaaacgaaagaataagcgccctgccattcttcttgatacagtatactccacctacagtgttgagggcaaacacggccaatgtcttatcccattctgacccttcattcggcgcccaaccaaattcctttgatagactacgagccagcgagtcgacgcgattggctacctctttcgacgagtatgacttcccggtaataccacaggtgtatgggtcccgggagctggcgtgtcgcactcgtccatatctctcattgagcataaactcgctgattggaatattgtcgggaattgggtccaattgaccggactcctttggaggtaaaaaaaccattttcccaaatcctcggggtaatataggggcaggtctccaaagtgcaggaaactgaggtgatctcggcttttttttgaacgtggttagctgcagccaggtgaacacaatggatttttactcacggtttagagcggcagtaagcaaggggttggagacacgcgggcaataaccagctgaggggagatttatgacaagtgacgggtgcggggaaatcggcaaaccaggcgaggacccccaacgatcataccgctagtacctaggtaggtaccgagtatattgtagcttcttgcgtttaaccgaaattgggtagccggcctaaatttgcgaccttggtctcggtggatatcctgcgtgcactgcgtgcactgcgtgctgagcagctcattgttggcggcgattatgctgccaagaccagagatgcctcggtctagacatatccgagggtatgatcgacgacatgctgcatctaatgtcaagttcaatttgcctcgcactgggaatttgatcagacttgcgataaattgaacggatttatcccgagaaatcgagggatcactgtctcctaaactccaatgaaaagcagaatgctcgcagcatttaaagtggccttggcatgcagatcactcaatctccattcgtccccattcgctcggcttacccgttttagactgtgccgaatatcttcgactacaccaacacctcgttgtctgaagccatatacgtatagaatgacatgacagcttggtacatttgggtaatgagtgtgctcaaggtcactacgcctacttaataatgtttcaacatctgtacgtataggaaaaacaggacgaatggactgtaaatgtattcagtgactacctctacctaggtgactagctgtataatggaagaggatgtgattaacaccccccatgtattccgtgggactcgtcaagtgactatcgagcccgaaggctcagccacgactttgtcaaagaacttccacgagaaagaccggtttgtttttggtgtagacctatatggacctcaacaaccttggtaatgttgacgtctctatgtataggtgatgcacggccctgtgcctcgcctgtactatctccgggggctacggggagatagtgggcgagagggctgagagaaagaagggaagaagaagagaagaggaagaaaagtaggaggaggccttttatacccccaagaacacgtaccttcccaaagtgcccagttcccttgcaccttccctgattgtcaatgtcatcttggctggcgtcgaagcagaattttccaacgtggtgtgagctgtcgggtagataaactgggaacatccggctgggatgtatctgcgtgtcacggattctagcaagtgaggactctcgttcacttcatctgacaagcatgtaaacttgtgctgttgatttaattttgcgatttatcttgcttccaaagttcgaaagggggagggaagtcattgatattgacagacagcaggcgacatcgattggtctgcgctgagcctggcaggtatcccccgttggcagtagataaatctagcaattacactctttcaggatcagactctccttgtcgtggcctcccaggtaacatacagtatccactgccctcagggccatagtctcatcgtcccatggagataactatccccattgtcctcgggtgtgctatagatgggtctcatatgagttgatatcgcagtattcaagagaaatcataagccttgggccagatttgcccttacaacactcatttcccggtatccatgaactgtccaattgaactaaacagacaagactagttgctggggtccaattgatcttactcacttccataccctaccctgggcattttaattggaggatcaaggaacgggttttgtccgtccccgtacaagaagtcatcaacctcctttccaatccatctcgcacgccctggaagagagatatcttggttgcagccgacagtcacatttcgctgtcgatctgaccagagacggctttcccggatttcctcgcgcatcttcgcaaggaaagaatgccagtaatttccgttgtccaagaatgttaagaaacttaatttcacagatcgcacagttgcagggagctctgaaaggaacgatatcacgtcggattcgctgactatcaatcgtgatagctcaaagtgttggagtttaggccagttctcaatggggaatatgtccttcaggggcacaggcgtgacgtcgtgcagattcttgtgttcgttttcggcgtcaattcctgtggtggctaggctgagttcttccagatcgcctgcttcgcgtaatatatcatggagcttttcatgggggaatgattgccatgttccggcgagagtgaaagaaggtccgaggtgatgagagcccggtttcttaagcagtgtggccaagtgattatattcctcacaggtatcatcaagaatcgtgcagttaattcccgtgcgaagtagacgggaatctacactgaactcgacgacatcattcttttcttcagcgagcgtgcgtgccacgatttatcatttagatcgcatagatgatatgtgtgtgagcgcaggggttaagctagtataacttctaccccattctcccgacctgaatccaatcgaagaattctttgccgaactcaaggcctttattaagggtaactggcaagtctatgaagaggatcctagccaaggtttcgacgattttcttgatcggtgcattgatgttgttggtgagacggagcagagtgctaagggccattttagacacgcaggtctaatggtggatgattgctattgatcgcatgtcaagcaaatagttattgtaactgtttctctaatgctatctatttactatatctagatcatcttttgagtgatatatcagtgatgtatctttatattggatcatatctgaaaaactatgcttggcgttgtatccttgttgtatcattgattcttggggatgaaagaagtagacttttagacaattcgtgctttatcactaagatggcttattacctctcgttctttattcaagttgcttccaaggttgactgatgaatagtcatgagagaatgagtggtttaagagcgataccccgtaagctgactctgagcgccctcataaaagcggcagccaagataggaaagtcccacccggcatagaaaaaaacactacgtagacgtgcctaggtacctaggtagcgaggtggctgggcctcgtgggttaggtgctctcatggtgttatcaatctcggggtttctcggtggtgtccatctcatgccacactaacataattccattgcttgtaattcgaagttcataatgggcaatccatggactccctcgagattagctcatgtgatgtccaagtttactgccggcttgaccccgacctcgatgccgctctggcaaaatatatcttgggtcctcccccagctccataatcctcccacctcacacttcatcccgtcctcaaacgcttttcatccatttcaagcattgaatgattattcgaagctaagtactgtctgaaatattatactgagaacagctaaaataccaattcaccttgtgtggtgccattgggccctctatactgtgagtctgactatcaatctccaccagcagatttaattttgttggctgtttaaatatgttctgggctatgtctggatataatacttactcaatctacgggagaatagcttgattgcacagcaaattgtggaaaatggcaccacgccctactgccaatcgtcgccaggcggttgaaagaccagtgcgagcaagccgcatcgccaagacaaagaaggaacaagccatcaaaggtgacaatcactttgttacatctttatcacgggatataacatgctgataccatacagtcccatcggaccagcttgaagctgctgtcaatgaccaagttcttgagccggtttatgggacacccccggcctggtccgaggtattttactaataatccatggtaatttatatgtatatgtactgaagaatctgccagggtcgtcagcaactttgtgatgcgattccgtggtttcgctgcactcaaggtgcaatgtatcacaatgaaggtttctgctatggcttcctcattgatgctgatggtggtacccgcacttatattgacgaggaagtcataattaccagaatgtaagtatcgtgtgtccggagttgtaacctgtctctactaacctttgtcagcggcggatgctgcaccaaagactcggggggaaacctgaccctcgaaaggaaccaagacccggacaatgcacttgtccaaagtatcattgccagtcaaaaatcaaagcttgctgttggccttgttattggtaattcatcaagagtgctataaaaggaaacctgctgaccacagttatagggagcaggaacaaggttctcaaccgagagcttccgcatcggtacaacattatggactggttccgtgttaccaatgtctggtttgaaaagattggccagaaacacggagtgaaggtccgctttgagaaactgaatctggccgagaagagctggtgggcggccaaggactctctccctccagtgcccctcgatgaacgggactttgaaacaaagcctgagactctcaagtgtgagagctgctccacggaaagtgttcgcttgtacgaggaggggtggatgtgccttgaccctggttgcgtcgacttctggaagatcgggaacgcttcccctcccgctgagctcactttcaatcttgatttcctgagctttcgcagtcgtccagacccggcaattcagccgcactacagtctagtgcccaatcttctgtccacgttggatgagaacgccgcggatgttagcacatctcgtatcgcatggaagggaatcgtctgccctatgtgttccaaatgtatccgtcgaactttctggcaaggctggaaatgcgacgatgactctatcggcgaggagtcctcaaacagctgcccgtttcagaagttcatgaacatgaaccctgtttcgctccgggttgtcctcgatcatttcgaactggccccgatcaagcgagcaattgtttttgaccggaagttcagcattccagagattgacgacaataccttcttcccgtaccggaagctgacttacaaactcgatggagttggctcgattacccactttgtgtccaacaaagcaatcaatagccgtgcgaatggaccagatgaccttttcatcaatctccaacgtggtgatcttggtctcaaacgattccgactccagtccagcctaggtaagtgagccggatacaacttcagatatagtttctcacaatggaacagttgcgggtacactgacctcacatttcgccgtcaactacgtaagtgaagagatactaccttgacatttccgtgtccactgaccaaaggatacagggtatgccctacaaatatgtggtgtctgtcgattccaagggcttcgatgaagcacccaacgacatgctccaagctctgggtcgcttgtcgtgggcaactgaaaaagcagtcgtctcttctggagacaaatacttgcctccaaacgagttgctaacactcggttatttcgaagaaatgaagatcggagtaagtcagatctatgacattgacaacggcctaagctaaaatatcttccatcagttccatgatgacggcgagtcttcgcttggccccagtatcgccacactgtcccttggagcgaaagcaaccatgttcgtccgtatgaagtacaagtatttcaacggctctacccgaagggctgagcccaagcagattgggacccttctgcaagatgaccctgttctaaaagactgcatgtttgagaacgaacggcggacactgaaagaagagttcgatgccggcgagatctcacaagatgagtatgacgactcgcgtcgtgctctgtcgatgggccgcaagggaaaagaggcaccggttaccatcaagatggaacttcatcatggtgatctggttgtcatgcacggagagtatctccagaaatactatgaggtttgggattgttcccctctttaccaacattgagcatcggatctgaccgctatagcattccgtggtgcccgagaacaagttgcgctttgctttgaccgcgagatacgtcaagcccgaccatattgacgcgaaagagattcagaaaggccacttctcactcacacccgaccaaatctacgatggaaagtgatattactatttgccgagtgacacgatttcgaacatctttcccagttctgccttcccatcttgccaactctgattgctgatttgtatgacttgagtaccaggacgttatttatatctatcatggtacttagtgccgggcttaactttccacatctgttacgaatatctctatgatatgcccaggtcatggtttgctgcttctttttttttcttgctatataccctactgcctatattctttgttgcgtggttttaggagatatactcgcgcagaagatcactcgacggctactgccgtgctatcaaatattatagtttatttctgcttttcgagcccaggaggctttcttagaatggtgatctcaatttctgtgtaaggtagatacgtttgatgccacttaagaaagagcgaatttagttcttccggcttcacctggacgctcaattcgatcgacccatcaatgcgacatgcctcgactttacaaaaggacgcagttgtcggtaataaatatcaaaaacttgctgaaatgaaacgaatactagtcaactcacctaccgaactgcctattaataggcagtctccacataattccccggttcggtcggagtgccgaccgaaacaggaaagcagatctgaatactctcactaagcggcaccgcagcctccgcaagccccgagcgatgttggaaatgctgaaaagtcatgttccctcctactagggcatattaattcgaagtgattgcgaattacctaatgaatgatcaaatgaatgacaatgtgctgcgagctgtgagtgccgtcacatggcttttgggattcgcatactgatgatgatattagtgtgacctttgctactcgagaaaggttaaagggcttcgtccaatctatttactgctcggcgactgatatcttttaataggttcgctgtgataggcagctagattgtgccaattgtacggatgcaggcgtgaagtgtagtcgtacaagagctcaacgacctcaccgacaaccatcggtgtatgtttccatatgaatccatcttacttttcctttatgcttacggggcttaatagtatatctgccctcggggaaaaattgttaaccttggaaaggacagtttcagagtatgattgccattcttcttctttacatcgggactccagttgattgacccatagtgaaagtctcatttcatcaaatggtgcagatcccaacaatagagatacgccatcgagaaaaaggagactagatgatgcctggtgcatagaaggggcttcccaatctgcccagaatgagtgtgccgttggcccgacgacacaccatgcagagaaggccagagtcgtcatacaaggagagcttgatggaaatgaacgaatggactgtgaacgaaaggcaatcctcaggtctgccctccaatttgtggatattacgggccagaggagaacctcagttaccgataagtcttcgccgctagaagtggcgtatgaagattttcaacatgatggaccatttattgccccgtcgccggagctgctttatatgcttcttccaggtagtagcattcattttcattgtcaatacatacactaatagatatacagacccaacagctgctgtcggacaatctagttccgtacaatggccggaccacatctcggataaaacactagagaagatggcttcgactattctcagcgacgatggccttgagcatggacaggtattctaccagtattgtatatgcgtttacgtgaaggccatattccatctcttccggaaaccgaaagcatataaggatcctcgcatcaacgcacaatttctgaagtccaagaaattatatgaaacatatgccttccgcgctctcaagaggctcaatttcctgaatgccccaactattcccttcattcagtcgttgatatctgctgtatgtcatcaagcttccttcttcggaaactcttttattgacaagtattgaacaggcatccttcatgcggtatcttggcaacatgagccaatcgtggattctcaactcatacgcagctcgtctgattactgctctgggctaccatgaaattcgcaatccgcttgggatttcaagcctcgatgaagaaatccatagcgctgtatgttggtgcttttaccttgaccgaactctaagcacccttctgtatcgaccactgtcgttgccagagcctcgcatctctcccgcgaacttgatcagtgccgaccaatctacggcacatatcccattaatacgcatattgttcgatttagctcaggtccaaggggagctgctggattgcggcaatgcggataatactcgccaaataattgccaaccactcaagaccccaagaacgaatggaagcaatacattcgacattacaatcggtgagtttgactgaatgcctgtctttctccaagctaacctattctcttagagtcgagcctcagcacccgactgtatcgctgcggattggattgcaggtgaattttgttattacgcgattctggttgatattcttcgatcacgcttaaaatgtaccttttctcctttgacacacagggagtgtttgtcgtattcccgcaaatctctcagggcactgcatcaccttcagaagaatctcgcggatacccctggcttcgtggatccttatccatcattcctaacatggttagttaatctattcccagcgtcatcagtttttccactgatatctcttcatcgtctgcaggactgttcttctatatcccttaagtccgttcttcgtcctcttctgtaacatcattggagaactagacatggatgactacaatctaatgcaagacatcacgacaagtctatctcagtttgccgcaagtccatacatctcgaaactgctgaaactgctgcactacttgcaggatctctgcgtaccattgattcaagccaagcagcgcatgggcccgcaggtcaaagtccctactctgtacccttcaatgactgggacttggcacgaccatccggctagtactgatgagcatgcgcatgtcttgataaatggttcttcatgcactgatcctgtcactggaggaaaccctcagcaatggcagacgcccagtgatggaagttatgcacctgatgatgccttgatgtggcaattgtttaatagccaggtctcgctggagtggttcgagtcagaccctttttcttattgagaatgcgcgttgtgtttgttgacatacctgtctcagcaattcatctcatttctataatcttttggtttctttgccttttaggtcgaggactgttaaccgtttgtttgtttcgatgtatatattgggtgaatttcatagcgacgataccaaccaccgactgttgctgtgtcctggactattctagaggccaggcccaattatatgcagtcgttttaggcaaaaacatactgtttcccaagcccagtcactgcatatgtggttgtggatgcaatatatacattgtgggggccgactccgactcagcctcacagccttgccccgaaaaaatacgagaagaattgggggcgattcttcatgttgtaggattcatgcccaggtggccccatattacatatgtacctattgggtttcatgatatcttcaaattagatatatgatgtttgatattggtatgatttggtagccaaaaagaaacacctactgaggtatggagtacagtatgacggcactggacccctaccggatcctaagcaatagaaacacaatttgtaacaagctgaaggtaaagacatcatatatatgtgcaattacacatcgtaaactcagataatattggacttgcagtagatcgtgcccagattgatatcagcctcgtaaaataaagtgtcgtggcaggtggtgaaccccgttggcggtggggacggtacctcgactagcgtgggcgcagctgatgtcccaacacacccccatcttacccaaaacaactcctttcgcatctttggacttggtctctattactatatcgcactcagtctcattgggaatgcccagagccagctcttcgacagcgtgttaccgacccgcgtggtcgttcccctcattccaaacattctgagttgctctggactagtcactcgttttgctattcacttgagtgcccgagatcggaattcacagtcctgctaaacaacctctcgcgcaaaactggacgcgtcgagtcgagccaagtcgagtcgatatctggtcggaacctcacacctccgaaaacatgtcgcaatatccaaacggtcaacaggcatactacggccaatccgcaaaccctcaagcctctgtcccaccatccaccggccactatgaggtttattcgtccccaaaccccgtgccggaccagcatctgcctcgaaggatgccgagttacaatgccggggatgattctggattcttcaaccctactcgggcccagaatctgagagcgaccgaagaaaacagacagtattcagcacaaggcagtggttatagtggcagcgcgggacagggtggctacaacgctgtgcaggggggctttgaagatgacggagactcgagatattcacggacttcctcagacgccatgtcgcgcatgtctccgactcgcgcctcttcgcaaacctccactatgtcttatcaatatcaatattctggcgcaccttcatcccagccgccctacaacccacagcaatatggccttccccacacgcagtcgcaaccggtcctcgcttataaccctcagacgtacactggctccggcaatgcttcttacgcccccccagcctcgggccatcaaccatataatcctgcggcctaccagtccaccgctgtgtctggactaagctctccggttctacctagaaggcagagcgcagcttcacactacgggcagacaccgccaactccgcaatcgtacggcttctccccccaacaaccaccacttccaccgccgaggggccctgatcacccgtacggaggacgttcataccaacccatgtcacccatcacttcgcctaattacgtgccgtcaagctccccgggcataatgcacatgcctccgcctacatcacgtccttattatagcaactcccagggggctgctgcgtatgacatgccatctccccagtacaccccagcgatcccaagcggttccttcgaagaacagcctcccatgcctccagttcaccagactcatgcaaatggcctgtacggcaggccaagtgtatctcattccgtgtcagggcgaaccctgccgacgccccctatgcagatagacttgcctcaacatccaccgagacgaactgacactttgactcgacaccctcaatcacggcctcttcctggacccccagtcgatgaagccggagcaaatggcaatcactggccggcggaagccccgatggcatatgaagatgtgataagagaggatgaagcggcagcgttggactctcaaaactttgcccggcgtcacagttctagagcttcccatgctagctctgcttcacgaatgcacttctcgcctgatgaggagcacacccacaccaatggtaacatggagacagacacaggccatatgaattatgatgcctacagtgacgaaagcgaccccgaagctgccgctggtttgatcatgctgcaagaagacatagcacgtgaagagcgcgagaaagagcggatgcaacgcgataccaatacctcagttcgcagctcacgtggatccaacatttcgccaagggagcattcaccactctctgatttccatgacgatgccgaattcgtccctgacctatcccaggtcgaaggtggctaccaagcaaacgtgcactacggtgtttacagtccagaagatcactcagaccctgccgcggacaacagatttccaggcacatctggttcattcaaaagctctcggccgcacgaagagcgtggtgagtattataatggatatggacatcatccgcgtctggcatatgaatatgccagacgcctccatcatacgccggccgatgccagggtagatgccagtggtacaggaggattatcggcacccgatgcctatgggcggcggatgagcttcgactctggcgatgaaggagaatcgccatatgatcagacgcattctggagatcaatccgacgacgagagcgcccaccgatccgcgcccgaagatctcttcttccaccctgggatgcgtccattgccaccagcacccgttgagcctgccggcaatgttgaccttgtgtcgtatttgatgcctgcgggcacatatagcagccactcggagcagcaggatgacttggatagttattcacagtataaccacccctccttgccaacctcagcggagtcttatggcgatgctttgctgagctcgtcccaagttccgcggtcgtcatccttgtcgacccctattgggcctcgtactgatgcgcctatcaggtcgaagaccgatgccgaccggctgaggtacaggcagcagcagcaagagcttctctcgcagcttcagcaaaagcacctacctcatatcgacccagcagcggcagcagcggctatgacgctggatctgccaagcatccccgctggccggcgcaagaagttccatcccgcgaagctgtcatcggaacaattcaagaagtgtagcgagccgtgggctttgagttccctcttggcctggattaaagatctgagtgaggacgagacagatcttagggagcaagcaattgccgatgccatggtcgcgttgttcactcataaagtccccaccatgaacattgctgatgctgagacactggctgctcgagttgtgaggggtatgctcgaagaaggtgcattggtgaaagaagaagaatgggtcaagtttggctcaggcactctttcgggtatcttgttccagatcaccggcacaggatgttactcgcccatgctccacttacacgatgtgcacattgagggtactgatagtttcggtcgatgctactcgcatcactgtatgcgaacattgaagaaggtcaacctcaaggcgcaaatgatggcaccgcagaagaaaatcgaggactgggtcactttctacaaggtgcccaaggaggtctgggaagcccatccgaggaaagaagtcgatcgacagaacaatttgcacgaaattgtcactacagaagactcctacatggggcaactggatgtcctacgagaactttatcgtgatcaattggctaagatgaatcctccgatcattccgccgaaacgattgcccaaattcttggccgacgtgtttggcaaggtggattctgtgaagagagtcaacgaggatttcctgttggcacagcttaaataccgtcaaaaagaacaagggcctttcatctctggattcagtgacatcttccgggaatggattcgcaaagctaagaatgtatacatcgactatgctgcaaccttcccaacggcaaactatcttatgcgcaaggaggctgagcgcaacccgcacttcaagcagttcctaaaccaagcccgagaacacaaactgtcaaatcgccttagctgggatactttcctcaaagctccgattaccaggatccagcggtatactcttctcttggcgactgtccacaagaatatggtcaaggatagcgaagaaaaggcaaatctggcacaggctattgaagagatcaaggtcgtggcgctggagtgtgacaacaaagttggagagatgaacaagaaggccgacctgatggaattggcatccaagctgcaattacgaccggacatgaagaaggaggttgaactcaatctcgaacacttgggtcgacagattatccatcgaggcgagctacaacgtcctggaacccgcacaagattcctcgtcgatacacatgccatcctgttcgatcattatctcgtgcttgcgaagatattcacaatgcgtgaccgggcagtgaagtacgagcgatacgatatttcaaaactgcccatcccaatggacttgttgggcctggaaagcaccgacgatgatcccgtggtcaaatcatccgttaggggagtggcgactgtcacgccctcccaagcgggtgctgccagtcctcttgcacatacagggcctggtgcatctggagcgaacggggttgttgacagctcgagggatgacaagatcctgtaccctttcaaaatcaagcatctaggcaagactggaacatatactctgtacgctttctcggcacaaagccgccaggaatggtgccaaaagatcatcgaagcgaagacaaagcatgccgctgctctcttctctcagaatgccgagccattccggctgcgcgtgcttgcggacactgcgtttgcatactctgatcatgcacctggctccaaaagcgtcaccatcaagggtacccctctccatcgtgcgatcacagaagttgagaagcaatatgaaggcgagaaaactcgtcctccagcagtatgcaggactgcagtcaactgtgccacggtcttccaacagccacctggtcgcatcatgtgtgcaatcggcacagactatggagtgtacatgtctgagctcaataacccgcggggctggtatagggcgattcccatcacgcgggtcacacaagttgctgtctttgaggatttcaatctgctgttgttgattgcagaccggtctttgattgcataccacctcgatgtggtctgtcctcccaatgggaaaaactcccagtcatctcaggattcagcccgacgagccccgcagaagttgtctggcaaccgcgaagtgggcttctttgctgctggtcgtctgaaggaccgatacttggttctgtacaaaaagcgtgaggggttgtcgtctacattcaaggtatgtacagtcgcagcaaactgaaaacaacagcaaactcacacgaaaatctaggttctcgagcctgtcctgcagaaatcatccacaaataagagccgcctgttctcgcgtcgctcacaaactgagttcttccgcgattacgacgagttctacatccctgccgagacctaccgaatcaacatgttccactcctcgcttgccatctcgacccaaaagggcatcgaagtcctcaccctcgacaagaaactttcatggtctgtcccagactttaactccaacgatacccaagatgcacacgataccctaaacagcatcgccaatcgcatcagcgggctcaagccactaggcatgttccgtctcagcgagagcgagttcctagtagcttaccagcagtgcgccgtgtacgtcaacaaacacggcgacgtctctcgcagtgtagtcatggagtttgtgggcagtgcacacacagcctgtctctatggcaagttcctcattctcttcaacgacgacttcgtcgaagttcgcaacgcaatgaacggccgcttacgccaggttatacccggccacaatgtcgtctgcatcgatgacggcagtaaggtgccaggctctctcaatggcaatgcgcaggccaacaccggtggctcaatgagtcttgctagcggcttctccggctctaccaatggctctccaggttccacgggtttaggcaacacggtcaaaatctgcatgcaacatccagagtatgagcggagccagattgtcttggagcttgtcgagaatgagggacaaaaagactaaggcagtgccagtcggccgtcttgggtctgtcatcgttcacatttcgcatctttggtttcgcacttggagcttgcatctaccacaaaacttaccctttttcttcgccttcttcgtgttcctttcatccacccaaccgcttttcatccctttctcttttgggcctttattctccgccgtggttatccttcttctctatggacggtggctcgtttgtccatgcctatgcttgttttataccctttttcttcatttgcgtcgtcatcatacaatgccattctagttcctcttcgaaggcttggtggtgactgatcgcttccgccccctggggttattccgcctgcttgatgatgatgctgtacatagaaaacgtcattacatctcatgacttgacgattctctaaattcagaacagttttgatttatgggcgactttgccctttatgaatttttgatttagttggaaacttacgggtctcgaatctattttttgatctcgacatatttacgtcgcaaataccttgtagaattctgtacacgtacgaagagtgctacaacgaatgcgcatgtatacatgaacaagggatgatccggcgcgaagttctttctaagggaatctagaatcaaggtcccaatccgacagggaccacgcgaaagaggaattgaaacatccaaaccaagggttgtagtacaaaattgtatgacgatctaagcaataggtcggcaacggaaaaaaaaaaaggaaacgcatgagatggcagtcaaccgtatatgacatcagacagtatgcaagaatatcatgactcgaactcgacgagcttgctgataacttcgccatcacgggccgtgggggagccatcgtccttagcagaagccgcagagccggacaccttgcgaggagcgtggttcgcatcatcctttccgtccaagagagaagttctctcttccttcccaccgccaagaacctcagctccttcaaggaggtcacggtcagcgtcacggacaatactacggcgctccgtatcagcgccgtatgcgccagcgccccagctggggataccaccggggatggcggcggcagtgttctcacgacggggatagtcttcgtcgtcctcttcgtcttcatcttcctcgcggctgagagcgttacgctcgagatcgcgctgcgcctcgtccattcgcttcttgacttcggcggccatgcggattccgtccgagacgatgttgtccaggacaccgcgcaggcccttgcctggtggcacgatgcctcctgaggcgccggcgacgggtgctgagcctgcagcgagtccggaggaacggatgctgcctaggttggagaaggttgtgaggttggacgacattgaggatgatgcggctagagcagccgggtggggatggtcggataggtggaaggattgagggaagtaggattcaaagaactgctctagaagttcgtcggccaggacaaccattcggaaggtggggagagtgatgtgtaggggattattaggatcgagagccgggttggcagactcagacgttgagcggttatggtcgtcgctgtttgattcgggggtcgctgacttggctgtctgggcggttgcgtctggtgctggagagctggcgggcttggtatcatcaacatcaatcaggtcttcttcttcgtcatcatcgccaatggcaaaagagtctagcttctcagttgcctctgccgttgcatcttgctggtctgcttttcggttttctgggtggctggggtcggcatattcgaaacagcgacggatgaatgcgctgacactaccaaggaatttctcgtcggtagtaagcgagttctcagcatggtcgcggtctgctgtcgagttcaggttttccacagatggagtggccgtgattgtgccctcaaacccacgccgggagaggaacaacagcgcctcggagattttgaggattccctcacgatcaacttggccatttccactgtcatcgtacaggtcgaagaaatagttgatgttgttcatgatgtcaggggatcccttcagccgggcgagaccattcaccacattttggagattcaatccctcctcggggtttgtggcccacttgcggtagaggcgttgcatgaactcatggtttgctggctgtctgcggttcgcccacaatgccgatttccctgatgatggttctttccctgacggcccaggggagtcagcgactgcccatttggacgtggccgctaaaaattcccggaaggcttcatagtccatatgtgtggggctaggcccgagaccgacacggccaacctgggtatccgcaggaggagcaagcatagaaaggcgctgggatctcttccgctcttgcctcctcgtctcttcctcgataactctctggcgttgctcccactggtacagtgtttcatagaagcggtcgtatatcgttccaagatcatccacactcaggcgtttgctttcgggtccaaggttgcgaatagaagtacgcttagcaaaagtctcgatgttttctaacacagcgcccttgtgcttctcgcgtgtctcggtgatcgtgctgtgagtgataccagaaaactccttgaaagcaaccaccatcaattcttggaatctagtgatggctcgaagcttgggattctctgatctcgggtgggcagattcatccagtcgtgagaaatacgacttcaagacagagataaatgacccgtcatcttgtgtctcgagaagctcctcgccattaactcggagaatggcaagaccgacctggaagaggactttcggcccttctaagaagaacacatccaagacacggaaagcaaagacgagcggcatggagttaatatatagcgagagaaaccatggcaacgataccacggaaagttgtacatctgatttggtgaggtgatcccagagaactggcattgttttctcgactagagactcaaacaccttctggtcgagtagtgtgccgtacatcgttgttgaatagtaacctggaaggagacggtcacacagcgcagagagaaggaaaaaggcttgtgcctctgacatatatctggtcaagttagcagacaccctcaataactgggggttctaaacacacatcaacaaggcggcaaccacaatgttcatggcttggcaatacccaatctccgggtcaatccaactgtacgcagtgagtactcgccgcaagcgtccaatgccttcttcgctctggaatccaggatactctggcagactgcgattcaaatctttctcaatctcatcgatagcaagggattcttgtccatcaaatttggacaatgtctgttgatacagcatcggggattgtagacgaaggaacagagaaccggatgtaagttcccaaatttctccacgtaaccgatttggcaaaccaactctgatcagcttgtggaatgttggttggcgaatcaacgtggcattgcgaccattttctagtgagatcggtcagatattggaatatacgatcaaaagatagatgactttttacctctgaaatattcgccccaaagtctcatcttactgcgatcgcgcagcttgcgcgcatcgccagggtagcggaaaatcagacccaggccggcatccggtggttgacgagtatctgactcattcccatcttgcccctttccttttgcacctgagagcagatattccgaatagcaatccgtgacgacagtccgcaggttgtcaacctccttcattccttcccgcaggccttttttcagtgtgtcacagaatcgctcgcaggcctgtctgctaccgacaagctgcaatatgaggcgttgagggacgaggttgggttcttgctgcttattgagcaaaccattccatgttgtgagcgcaagggagaagacatgactggcgctatgaaggcgttcgacacgtcttatgcaggatagcgggagaacgaatccattgcctgatggcccagtgccgtgtgtctggccagtccaggcggtcgaagtacttgcagtggcagaggggatgaagcttgtcggttgggttgaaaagcatatgaaacgttcactcagatgcagacgtccagtatatgtgtttcccgcccggtcaaccttgcgggagccatctccttgattggccgaggaatttggtagcggtagaacgagatcagcggtgatctcttgaagcgggttctgagaatcagggaggcggaattgttgccggaataacgatgcctttgagggattatgatcgggcgaggatagggcgggaatgttgaagttggcggggtcaatcaggctctgggccttttgaacgaaggacgaccacggtatcatgttggagaggtgacgtgggaatttatgtgaatgtcctgaagccgataaccgatgatgtcgggatcaagctacagttactccgagtccagcagatccgggctaggaataggaaaaaaggcccgtgcgtagttgagattggagcttcgaggtcatcgtacaagctaaatcatcgttggccgaggactacgcctgcagaacaaaaggattgcgtctggtgttgttgtcggattgataagagggggcgtgatgatgccgggttcacgtgaccatcatcagccttatctgtcgtcccgaggggtttgcagggtttgtattatatagtggcctcaggcactccacagatctatagcctagggccgcgtataaaagaagaaggggtttctattaactagttaggaagcgagagacttactagattatataattatattcctatatgtccatggatggcctatctagcactatctagtagaaagaaactaatccagtcggcaatgtttaaacccctcgatgatgatatagttctgctagagcatggcatgacgcccgatgggaatatcgatcccgatcttaccaaggaaatttgtcagacggctcttttgagacattttccaccgagactgaaaatggcacgtacttccttcgttcgacctttgtcgaccttgaccctccgttacatatatgtaatgagtccagaaaaggacaggacttgtagaacatgattcgagcgagcttaacataaaaatcgaagaacacattgaaatgaaacaggatgtaggtagaatgagagcaagaacagactggaacaagacaagatccaggaatagaacaagacattgacaaaaaggcaagggcaaaaggataatttggcacgaaacaagatttgaacaaaatcaagctcaaggcaatcattggccattgaaaattgggtgtgggatagctcactatgagcgaacaagcatatgacattgactcagcactatgcagactgtgcaagtggaattggacctcaatcaagagacggcagaaccgcccatgattttcgggtgacagagggccctgtaagaagcaccaaaaagcatcgactgttgaggaaagagaagacagagctggcttggcaagtgatcggcataggccaaacgacagaggaacacgacagaggaacttggtcttcctttgcttctttgtctgttgatttcgttcttgtcgagtgaccggagcttcaacaaggcgtgaacgtggatctttttggccctgggaaagtggaccaagcgacagcggaaactattgtcattgttttctttttgtcttttgttcttgtcgattgacctcgagcttcatagggctaactgcaaccatgtggattgacggcggaaaagaggtggagagcctagtgtagctgatgatgggcatgtctgggtgagacgacagcggaactctttttgttttgtcttgttggtgttcttgtcgagtgacctgaaggttcagcatggcatgcgtgggtttggccgtgggtaaagtggaaagtgccgccggacaggttgtgtggccaagggtatcaacgacaacagaacttcgtggatttttctttttctttttatttttttgtggactgctttgttcttgtcgatgaccgttgagtatgatggctcggtgtttcccggccgattggcccggcgaatgagtggaaagaccagtccggctgccaattgctggtgcccaaggatagcagggcccttcttttggtccttgcacttgttttatttttgcttgtgtggttggtcatgtcttgtgcttgatgatccatggcttgtgttgttgtgtcttgtgtcgggttgtgccccatgtttcgtcttgttctgtcttgctgttccaaggttttgtcttgttccttcgagtggtcctttggcaccacaaggtctggtgtatttatgaggattgacggtggagagccaaccctagtgaccgttcttggtcggagacagtagatttttctttttcttttttcttttttcttttgtttttttgtttttttgcttgtcattgatagtcatcttgtcaagttcaccgctggtgtgagagaagcgtgtgttttgcggtggatcattcaaaggaaagatattgaaaggccagtctggaggtggccggtgatgacccttgaaagaggacttgaaggagtgtatgttgcccaggtgtattttgtattgtgtttgttaagcggtcgtcgggtttcgggaaatcagtgtatttgcgtgagcacttttcgtaggaaggaaaccccagctgagaaattgagcactgtccagacaggctgataatggccctcgaataagacagcgggcttgacaagatcaatgtgttcttcattttttttttctctgttttcttttttgtttcgtgtgttctttcttttttttctccatgttttgttttttttttttttctttttttctttttctttttttttaaatcttatcgagtgaggctcggttccgagaaggcccagtgtattcaggaaggacctcctcggacggacgaggaatggtcacgaggccctgcttttcacaggcctcgccgtcctcccaggcggccttgtgctccgaagaagtggtgccgcggtagcgttgccagaggaaaaccacagcctggccgaccagcatgccaatggcactggcggtcaatccagccaggacacccaaaacagccgggataacgataaagtgcacaatgcgagagaaagtgcgggcgaaagcgccgtggtatgggtggtgatgatggggacgagcggagccgtgggcgtgggcatggtggcgaccgtcttccccgaaaggaggcgggaaagggaaaggcataccgtcgtggccttgttcatagtggcccattgtcttgcccttgtgtttgccatggcagctcttgcggccggttttggtcatgcccataacacgagctttggcgccagccaacaggcctcgaatacgagagaccagaagttcctgcaggcatttggcctttccgttgcactccttccaggacaagcggtcggaggcaggagtggtgttttcaatttcagtccgggcgatgaagagctcgccgttgggatcctgtagaacggtgatcgcaacggtatcgacagggactgggtgggtctcgaggtcgaggacagtgaatcggatatccaggagttcatagcccggctcgtcagacggtgcggccatcggcatgatctcaagggcatagccaacaggcattgggttggagtcctctccctcttcattttgttgtacagcaagaattggaataggcggggccggtgggaatatttggcggccgttggccagcaggcagttgtcttcgatcgagaaatccagagtctaccggggtctgttagctagttcaaatgaataaacggattctatcatgcttaccagagaggatggtttgccctccgcccaggtaacaacaccttcgtcgttggtttcacgcagaggacattcagagcagggcaggtcaacaatcgcatgatgaacgtcctccaaaagcatagggtgaacattcacaaacccatcttcaatcatatcgactttaggttccatctcggggacgacgagcatcgcactggcgccaagggcagcggcgccacccagcaagacggagcgcacgaacatggcgatggaaggaaaccaaggtggaggcaaaatgtaagtcagaagcaaggcgatgcttccctccttaaatttgatgagacaggtagactcaacagcgtgatgaacaatatctcgagggggtatggagataagtgatcttctttcagcgggaagtggagtgggtgacgccagctcctgcgtggctcgtgctgtgattggtggatggctgatagtcagcctgctgactgtgttggcggcatctcccgagcttggagattcgtgtttggatgcgtaggctcaaagaccctctcagaggaacaccgagtggcatacaatgtggtattgttgccataatcttttgtaaaatggaagatggcgacgactccagttccaagcgtatagggtatgcgctcgaaatattgctgatggccgtactccgtatatcacagcataatccggtttgcacgtcgctttcagctaccaggagttggcatggcatctcctgagagctctgggttatatgtgatactgcatcatacatttcaaggtgacgagtcacaatgttgatggtggcgtgggctttcgccgagtgcgaaatgtgcacggcctggtgaatagtaggaccaaggcgcatactgcagtatcaggttttcaagcttccgggagaccataaaatgctcccagtttccaggagctgacggttgttgcaagttcctaccatcagcctgctcattgcgcaggtgccatgatgccagctcctaggaaatcaactgatattcccgttcctaggagctggtgattgttgcgcattggcacggtcagcctgctgaacatatgtagaccgcattggattgtgttcatgccatgttgccagcccccgggagattgtataatgtcccccactaccgagagctcgcctgttgctcgtgtcagctcccaggatatcatttgatgtccccaagtcctaggggctgacaacatggacgaactggcgaattcagcaggctcactatgcaggtggcatcaaatcgtgtttgtgccattgccagcccctgggagatcatataatggtcccatctcccaggggctggctgttcagcaggctgactatacgggtggcatcgaagcgtgtttgccccattgtaagtggcatagtcagcctgctgaacacgcaggtggcagctcttgtgctattgcaagcccctgggagatcaaataatgttccccacgcccaggagctggcctattgatcatgtcatggtgccagcccctaggagaacatttgatgtccccatctcctaggggctggcgggttgttgttgaatcggcgggttcagaaggctgaccataaggccaactcctaggagatcatgtaatctctccactgtcaggagctggcgcagtcgctctagaaggtggcatggtcagcctgctgaacacgccagcccctgggagatcaaataatgttccccgctcccagaggctggcgcattgttcctgctacgtgactagcaggctgaccatcgtgccagctcgtaggagatcatgtaatgctctccgctcctggagctggcggctgcagaaggtggcatggtcagcccgctaaacacacaggcggcagcttttatgccgtatttccagcccctgggagatcatgtaatggtccccgctcccagagactggcgcgatgttggtgttgctagcccctaggagatgataatggtcccatttcctagcggctggcgtgtttaacaggctggccatgctggaggtttctgaaggtaggatggccagcctgctaaacacgcaggtggcagctgttgtgccattgccagcccctgggagatcgtataatggtccccgctcccagaggctggcgcgctgttggtgttgccagcccctaggagatcatggtggtcccatttcccaggggctggcgtgtttaacaggctggccatgctggaggtttctgaaggtaggacggtcagcctgctaaacacgcaggtggcagctgttgtgccattgccagcccctgggagatcatataatggtccccgctcccagaggctggcgcgctgttggtgttgccagcccctaggagatcatataatggtcccatctcctaggggctggctgttcagcaggctgactatgcagatggcatcgaagcgtgtttgtgccattgtaaagtggcatagtcagcctgctgaacgtgcagtggcatgtgtcgtgccattgccagcccctgggagatcatataatggtcctatctcccatgggctggcgcgctgttggtgttgtcagcccccgggagatgatatgatatctccgtctcccaggggctggcgagttgttcctactgcgtgtccagcaggttgaccatgcaggtggtatttggaccatcgtgccagctcccgggagatcatgtaatgctctccgctcccaggagctggcggttgcaaggtggcatggtcagcctgctagacacgcaggtggcagatgttgtgctatattgccagcccccgggagatgatatgacatccccgtctcccagggtctggcgcgttgttcctcctgcgtgtccagcaggttgaccatgcaggtggtatttggaccatcgtgccagctcccgggagatcatataatcttctccactcccaggagctggcggttgcaaggtggcatggtcagcctgctaaacacgcaggtggcagctgttgtgctgtattgccagcccccgggagatgatatgacatccccgtctcccaggggctggcgcgttgttcctcctgcgtgtccagcaggctgaccatgtagatggcatggtttgtgccaccgtgccagctcccgggagatcatataatcttctccactcccaggagctggcggttgctggtggtggcatggtcagcctgctggacacgcaggtggtagctgttgtgctgtattgccagcccccgggaggtgatatcccgtctcccaggggctggcgcgttgttcctgctgcgtgtccagcaggctgaccatatagatggcatggtttgtgccaccgtgccagctcctaggagatcatgtaatgttctccactcccaggagctgacggttgctgatggtggcatggtcagcctgctggacacgctcgcggtgtcccgtatcggactctgttgcttcatggccatctaatatatcactctgaccccaccatagatgatctacccagtttcctgggtaggcagtgggtgcgatataaatatggttatatatcatatcgaagacatcatacatgaccccgaagggtccgcaacaggtgtgtgtaattgcacttgtgcaggtgaagcggcaatcgtcggacttgccagcttcctgccttgcaatagaagcatcattgttggattgtcagttgccatcaaccgaacaatgtccggtctccggcaaaactacgcaagatgacatggataatccactccaagagtggaacatagccatactcctcgcgcagttcctccaggaacttctctgggccctcaaaggcgtacgcaaggtgttcgaggtgacctagccacaatggggacgacagcagagtcaccatcaccatagcgaatacaccaaaggaggcccatcgagttcctgtccatagtacccgcaatagatccgagccctcatgcatgtctgactcgccagacgcagtgatgacaggtgggtcggaaggccaagctcctggcatttgaagaccagaagtcgctgcgtcttctccgcccatttcctcctgtacgtttcctgcagtcttttgagcgctgcaatttgggtcttcggcatcctcgaccctcttggcgccttccgaaacccccgcacgggaatctgcccctgttgcaacggcattttctgccgaagcgtcttcggggctggccaccagggaagaggtggagcgcctccgagaggttgctgtgacctgcaaccccttcagggctttgtaaaagtttggccgacgttcaaccctgcgaaagcgcattgtgggcatcgcctgtgtccgcgactgagtatcggtccactcgctcggaacggcacggtcggacccactcagagtcggctcagggacaacatgcaccctccgaactctctcagtccacaatggcgtagcgtgggctgacttgatttgggctggctcactaggagcaggcacacccaaaacgtcgtcggacacattcactctaagcgaggtgggctccggggcagcttgagtcggctcgggaacagcgggctcgctcaaagctgaagcgggaagaacctgctcggtcttgagagtgtcaatttcgtccgaatcagcttgagccggcttgggaacagcgggctcgctcaaagctgaagcgggaagaacctgctcggtggtctccgaggcagcttgagttggcttagagacagctggctcactcatagctgcctcagtcggcacctgctcggttgagacaccctcagtgtacttgaaatcggtctgagctggctgcgtaacagctggcacactcatgactggcacttccactttcacagcagtgtgacatgtgtagctgtctgatatcgcaagcaaccgggatccgttgcttgcgataatattgtccgtggccctcttcttgcgggtaggctcatccccgctcgaattgtccacgccagctgtccgtttgcgcactggcatgttgacggactcgaatgccatctggggcacacgacgggcacgacgggtaggactgacacgacgggcacgacgggtaggactgactggacgggtaggacgggtaggactgactggacgggtaggacgggtaggacgggtaggactgacacgacggacacgacgggtacgacgggtacgacggacacgacgcacagagcgccgttggtatggctggtatcgtgcatttcgtgcgtattgcttgcgcacgtgtgggcggcctcggcttttggctggcttcaagggttcaacaggggcatccggtatgacaatatcagagggatccgggcgggcaatatcagagggatccgggcgggcaatatcagagagggagggggcggcgttagaggccagaccaggaactatcacggcattctcctcgacggtagacgatggaggggggaaggcgtgttcaccagatgcctggctcggagccgccagggcatcttgattgattgtgatcacgggctcctcatcccagtccatgtcaacgtcttcgtccgtaaccagttccatggtatcctgcgacccatcttcctgtagcggggcggcggcaagttcttggcccttgggtgagctagcccgcgacgatctgcggctgtccaatgacatcacgtcggaaagcacgctagggctttcagaccgcgacctcatcgagcagtcgccatcgtcgacgacggactcggcgtcactaccagcaccgggaccctcagagaggagcggtcccgggtcacgagccttccctttgccgagctcttgcgggtggaaatcagatgcatgcccatgggagcctggttcctggcttcccacgacgtgacgacgcgcaatacccacagggttggtggtggactcagcagtcggagcactgcgagcccgcacctgactgtcccttgtggcttgcatggccgcggcaagcatgaggttgaggttcctggcgaggcctttcattcggtcctcggcacccgcaaggcgttgttggcgctgcaggttgaattcagcggctgcgactatctgtcgcagatcctggacatcgtgccggtccttttggagggcgtactgaagaccttggagggcagctttgtttccttcagcgcgctcgtgttcttcagacacctggtccaatcggtcctccaggatccggaattggcggtcgatgtcgcgagcccggtcgttgtaagaccggttgatcaaggcatctatatgcgcttgatcaacaaaccgagtggtgcgatgggtcgccacttgggatcgcagagcagacacctgggacccggtgttgttctgctcgctctcctggcgagaaatagtcgcctcggcatccgccagacttgcgctcaacgcggtgactccgcgcgatgtctgtcgtggtcggacaccaaggggggaggaacgggctgtgtcggggcccaccaggggggtgatcccgtgcgggggaccctggttgttgagggacgggatggcgggggtgggggcacccgccatttgaaacccgataacgccgttacggcgggttgatctctgctggtttgccattacgaactgcgagacaggttagatatgatgctcaaaaaattgcttacaaagtaactgaactcacaatttcgaaaatggcaacgcaaacaggcacgcggggggagatttcttgtgcgaatctatgcgacgacgcgttagaaaaggtagacagcttactcggacggggagttggcactaaccagcagtttttttgggcacttcgcagatgaaccacgaagggaaaggatgggatctgatgaaatctctgatgatggaaaaaaagaagagaggaggagaagaagaaagagaagttgagaggaaaggggagaagatataggtaggcctcgacacgcgacgtgttggtgaggctctggcaccttctgggtcaatgacctgctcaatggcttggtctcacctcctgagaccaatcaataggctccccattgtttattgatggcagggtctttctccaacaatggctattatgagatctccaataaagagaacaatgggatgtctcattggtcccttgaatgctctttttctaggaataggatgtctcatccagcaatacagtctacatcttttctgaatatgtgtctattcaattgtaccttttctagagttagctctacgtagagattcccagcagtagctcgctgacatacatgccctcgagatctgcgccatgtggttgcggctaaattgttctcggcctgccgaaggccagtgcactcggtttaccgagtagattttccttccatggtctaacgaaagcttggaagtcttggcgattgcgtaccgccaggtctacttacgttctaaaatatagtcatggcgggggctactgtcaccatgattcttggtcaaaaaagttgtcctgccccgactctcgtcgtcacgcattcacgggacgatctgcacgcttttgtgggttctactgttctggcatatgattatactgggtttcaagccctcctacactgggagtcattgctaacagaaaaatcatatcccctagagccgttttggggggatgggcggtccctcggccccacaacagcacatggaatacatacgagcacggtacgggccggatccgtcaagcgaaccaagcaccggccaccaaccagcaagctgtccgtggggatctacgcttgagtcaaagcagacgcggccacctgaattagcctacattgcacaatcacacgacggccttcgcatcatggagatactccatcaagcgaaacgacccaaatgtcaaaatcgacattggaccatttccccaagatctcatgtcccagttgacgcaattgatgatctaacaaccgaactgtctctaacagaccctcaaccgcgatacgagacctttgtagtcatacccgttgatcttcccatggcagggatcccattccacttgattttctcatcggtacggggtgaaggtaagcgtctcattttgccgaattcctcaaaatatctgtcgtgcaaaggagactgacactgtttccgcttcagatcccctgtccagacgcccaggaagcttcaaactaccagcagccctcgcagcaaacatccggcaagtggtctgatccgccagcgaaggatgttcaatgtgacgattcacccctattggtttcataatttcgaaaaccacccaacacccaattatacaggcaaggggcatctgtgaagatgacgtttccacaacatgaagaaagacatccattcaaacggggaaatcttgttcccaagcctaaataacagagtctatccatgccttccccgctcctcagctagcaacggtgaagaaagccattgcaccatcttagcgtctatggagcacggctcgctttgggtttgctatatagtattgtcacacatacaagtgtcgggaggagtgctttgcagagtgaagacagggcacagcactttgggcatgcgataacagcaacttgggttgatctagtcaaggcgacaacatcagaaatgtcatgaatggatataatatctatctgtcaaatccagtgtagttatacgtagtgttatctatccaaaatgatccgatgtattatcaatatcttgtgcatgatttcagtagctcaaagcttagatttcttgccggtcacgttgggtacttcatctcccgaaagtaaaaagtctgggtaagaaaggctcccaccggaagcaccgcctgctgacatgcgccagtttgcaccatcaactgtttagtgtcagtatggagcgtccatcacgttgttgttatctgacaactcaccaacaagcgtttgaccactgacatagctgccagtgtctgagaaaagatacaccgtggcatcggcgatgtcgcggacatggccgaagcggcccagcggctgggccttggtgtaagcctctagggcatctgctggtagcaggcgttccaaaccctgcagaatggtaagtggaccaatttttaccatacgcataacactgttgagggttatactaacctcagtttgcgcaataggaccgggcgcaataatattggaagtcaaaccgcgaggaccatactcgattgcgacactgtgcgacaaggcatcgataccagctttggcaaccgatacatggctctggaaaggcataccccgatagtgaatggtggcactgacgaagatgattcttccaccggttccaaccggtgatggttgaactgaaggattgtcagttgcaacgatagacagaggttcgggattcacccaatggtgcactcacgagtcgttgagtccattctgtgcttgctcgctgactcccttaggtacggaagggtcgccttgagggtattataagagcccaagacgtcgatatccattactgatttgaaagcgttgaccgagagttgctcgatggaggcgaggaagttacccgccgctccagcactgtcggatactatcagtattgagaatggaagactgccgtcaagttactatatcaacgtacatgacgaaatcaattcctcctagctccttgacacagcgctcaactgcttgctgcaaattctcgagcttgcgtacgtccacggaaccaatgccaatcaccttggcaccgggtcgcgctgtcgcgatgtcctgggcaacgcgctcggtcttctctacattacggccaatgatgcaggcgttggcacccaggtgtactaaggcccggacctgggcactacagatagtgccggcgccacctgtgcagaagacgaccttgtttgctggatcaggaattagcgtgggtgcggtggcgacgggctagaagagagcttaccgaagatcccatccttccaggagtcactcaagtattctgtcttgggcagcggcattctggttactatgtacacccctggataactcagtctaaagattgtgggggacttagggacgttcaggaggtcggccccaggtgatttaatgacacccgtttccccacagtcggacctcggcttcacggatttatgcatttatgaactttatgcgcccaagtttgtaatgcataagatattatgcgaatatgccaccttggaagcttttgaggaattatcccaaagctgttacagccaacactttctttgatacgctgtatgtagggaatgatagtggtactcagtcctcattatctgtgtatcgcgccttcatcacgctctagggattcattcattcttcatagactgtatcagcccgtatctaggtgtccaggcatacatgtatccgactatttcagagtcaagggaactattttgctgctattcgcaaacgtgtatacgtacatctatttttctaaagcgaattggctatctactagactgcgctctcaaaaatcaacaagctaggcagtgttttgcgactcaaacagctccacttccttaagtgccttggcgacagttgctaacagttggtcactgttctcgggcccagcactaatgcgaagtatgtgttggggcaccccgtactttgggaccttttctctgttccagtaattcgccagctgcacatatggaatcaccagaagttagttccgaaactggaacctttgttgcttacgcggggaccaatgtaaaagataagttcgcaagagttccaggaggagaaggtttgttttcctgtcgttccatatacaccgtgaaaattggccagtgataaaacgttctcatatatatacacatagacgtcgatatagtgccactaatctatcatagaaaaaacatatagattcctctcattgcgatgaagaaaggccacccgctgattggctggcgtgtgggcggaccgcgacgtcaccgaaaaagaaccgtctctcttctttgcattgttgacgcgaatattcgactcaaccaatttcggacttcgttgttttcattgaatacaaaatccgagacaagtgattagctttttattctgcaacatggcctgtcccatcagcgtcagcaagtttgttggcactgtctccctcggtcttcttaccgtacgtcaaccgcatctatcgcatcataaaatatggccaacaagactaacaacccctctcaaacttatagggcctctcctactccacatcaaacattacaatcccggctctacagctccttccaacagcgacaaccgccgcccgctccctaaacgaagtgaagcgtctaacccgccggtatgcactgcgcctctccttcctgaccaacagctgcttctgtttcgcatggtgcctgtcctctccgcgccgccgacacccatacatggtctggctgtgggcattttctacaatcggtgcccacggtgttgattactggttcaaccgtcacctcggcttcaagaactgggcctcggctgtcatccgcgacgtttcccacttctcccttgtccgggactcgaccacaaagaaggatgaagaccttgtcgtggttgaggctgaggaagacctgaatggcgagaccgttcagcgcgagatggaccgggagcgccggctccaccgcgcgcgcacttggttgtctggtattgcgctttctattggcattgttggtctctggggtgacaaacggtgatccttttctcctcattctgtgtcccagagtttttctttatggtgaagacactggttgttgccccatatctattttctggaaaagccttttcgctactgtttgtttgatcgcgtctaatatgtttcgtgcttgatacctttttgttccgttctctttctctttaggacatcttttcgtgaacattgcaatggaataacctagaatggagtaacttctaacttcgaatccggtatatccgagccatatttacaaaatcgtaccccgaccagccatgaagcgcatcatctaccatagacacctagccttgactaacgtgaatggggaggcagaggaaagagaaattgatacgggaatccagcgtttcatttgctatggttcacatgtacacgatacatcttacctataacacgcacatcagcataacataatatgtaccaaggtaatagctccatacgtacagacaaacaacatacaactagcatctgaagtagatgccttgaaccgaccagactcgcctgcaaatcatcctcatctttgcttaacagccctcagaccttgaataacaaggataattgttggtaggcttgccatgatttcccctagacaccttgcgagtcgaaaatgaacgataaaagtgggcagtcttctagcctagctaactcacataatgagtaaagatcattaggaacaaaagtaaggaataatagcagaatgtacagtaagtgactagagaggagagtgagaatagactgagatgagagtgagagtagagtgatatacaaagacacatgtatcttcgggttagaatatacctaggtattgtatgcgcactttatagaaggtttgtatatatactctgagattaccaaatggatcataccaaggtgaagacgtgatggatagataaataataaacgaagaagataccctaagtatcaggtagcagagtaatttcgtggtccttagaactgtgagctataaataccatcttcttccttcttcatcttctctcttcttacaacccctccacatctccacatcttcaccgaatggcactatatatacccatgccttgcgttcgtgagttcgtctcattcttacttaccccttgtgttctactaacatggtttctaggactataaatactcgcttctccttcctcttccttcctccgtcctccgttctctcccgtcgcctaactccgaagggcaaaacctcgtcctatgccctaggcctcgacgctaggaaaccattttatcatcgtctctttcgatctatctgcttttcagcctgagaagcatctactaagagacaataccattgccattgatggttagtcccaactaaccttccaagtaacccggctaccttttcccgacgcatttcgcacagattcgcgcccaccccctttgctctcaacttctcttttcttcttcttcttctcctctcttcttttttctatcatcagagatttcatcagatcccatcctttcccttcgtggttcatctgcgaagtgcacaaaagatctgctggttagtgccaactacccttccgagtaagctgtctatcttttctaacgcatcgtcgcatagattcgtgcccagtctctgggcccttacaaacctctctcgcgtctctgtttgccatttcgagacagtgagttcagtcactttgcaaaagctttcgagcatcatatctaacctatctcgcagttcgtgatggcaaacccacacgcaccagcccgccgtaacggcgtcattgggtttcaaatggcgggtgcccccacccccgccattccccacaccaacaaccagggtcccccgcacgggatcacggcaccgacatagcccattcctcctacgctatccctctagtcgccccggcataccgagcaggcgcccactgaggcagctatgagtgcgctagctgttccccagctgactcgagttgccctagaggccactgaacaggttcttcccgcttcagctttgagtgagcccgctgttccgaagccggctcaagctgattcggatgaaatcgacactttcaagaccgagcaggtgcggactgaggcagctttgagtgagcccgctgttcccgagccgactcaagctgccccggagcccacctcgcttagagtgaatgtgtccgacgacgttttgggtgtgcctgctcctagtgagccagcccaaatcaagtcagcccacgctacgccattgtggactgagagagttcggagggtgcatgttgtccctgagccgactctgagtgggtccgaccgtgccgttccgagcgagtggaccgatactcagtcgcgggctagttcacccaagggccaagaacttgccgccgccccgctgcaggaagatgggtcgcaggatactatggaactggtcaccgacgaagacattgacatggactgggatgaggagcccgtgatcacacctaaccaagatgccctggcggctccgagccaggcatctgctgaacacgcctcccccctccatcgtctaccgtcgaggataatgccgtgatgccagaagcaccacctattaccaccactatcatcaagccgcagcaagtggacaacacttgctcaacaactaggtgatctagtgtactactgaccaatccaaaaattcatattcctttcaatgatttccgccaaaataaaaacatgaaatatctagagtaatgaggagcaactcgagtaattcctgattctacgtacaaaaataaacacaatagcaatagccgttgattacacatgaggttgaacaatgccgatatcgaagggggattcgggtaaggtggatagaaacgggaaagaaaggcatggacaacgttgtgggtttcttgtcagaagatgtatataaaatataaaatatatagcatgatctacagaaacacctcaatgataactcggtcactatcgactggtatgacgcaccgcggagaagacgactatatcctcccaaatataggtttgaaatgagcagtggtcaaatgtgccatgtacccctattgactaggattaatatcgaggaaggataattagcaacttcgagacatagccagaccaatgatccgaagaaataaaattaatcccaatacgctaaggacaaccgcagagctgtcggaaatgagccccttagcgcaaaaagaataagaacacgacagcgtaggttgtgtttctgcgaaaaagaagaaaaaattactacagacctggattaaaatcttagacttggaaagcatggtcaacatcaccatcgtcaacggccaaatctacacgccaggactggcaattgtcgatgcgccacaacctaacacgcccctcggaggaggcaagtcaatacaccagaatatattgaccctttgctaatttcctagacaaccttcaaattgcaatcgacgtgtccggcaatggccaactaccgtggccggcatcaactcaacccgactcgtccacccgcttccacgacatcacactcttcttaacctccgagtcgcacaacttcaccgtctccaacggcacaaagcccgcgtctaacacaagttacgtcggtcccatcttggacctggagccctcatccaccgtcaaacatgtgaactggatttggcccgagtgtctcgtgggagacgactctggctcaaaggactcggcacgcgggacatacaacatttccatgcaccaatctttccgctggaatgggattgactattatactgtctttgacctgccaatctctgtcaccaacagcatacccgagaacgataaccggctcgactgcgagatgctcgaaaaccagctccttagcgcggcggagatcggcgagagctcggattcactgcctgggcagccgtgggttgagggtggagttagtacgacggcgttagctcctgaggcaagtcagacaggggcgggcaaccggtgccatttgggcatcaagagagtagctggcattgcggttgttatgacggctattttgcatttcctgggttgagacttcttcctgggtttcatcccttgtataccacttttcatcattgtttttgtcttgttcagattaacataggaaccatttctatacttccgcgtgtgttcaaccatattaagattcaaagtcaggctgtcacaattcctttacgacgatcggcgaataactgttttactcctttcgtcgacgatcatcgttgatatttctgctttgggaagtatacattctcacattgatcttggaacatcccttgattgccaagttctcccttctagcaatattgaatatcctctatccagggtctctcgaacatctccagtcatgtatgtcaaaaagaccatatcgcgcacatcgcaaccgaccccgacgttgacaccaaagcaccaatctccccaataccctcgctttccatgacgattttgtccacctcccgacgagtcctccggtatcgcatcgcccgggctctgattataatcttcgcgatatggaatctagccgaaatacatctgattcagcaccgaatttacgaagccgagtatactgcgctccgacgccggccacagaagcaagaacggatatatattgcaagcatcaattggaacaatgagctcattctacgcagtcattggagcaaggcactcacacagctggtcttgaagcttggtcgtgaaaatgtgttcatcagcatatacgaaagcgggagctacgataacacgaaaggcgcattgagagaactggactgggaactcgaacgaatgcgggtaccccggaatatcactttgtcgcctgtgacacatgaagatgaattagccgcacctgcagatggcgaggactggattcgcactcccgatgggcagaaacaactacgacgagtgccgtatctagcgcggatacggaacttgagcttgttgcctctgcaggatctcgcacggcagggtatcactttcgataaaattctgtttctgaatgacgttgtgttcacggtgagtacgagtcagcttgtcttctgcgaaggtgtattctaaccaagaccatcttttgttgaccagccgagcgacgtcctcaaacttctcgatactaatggcggcgaatacgctgctgcttgctcgttggatttctccagtcctccggactactatgacacatttgctctccgggatagcaagggccatgaatctattatgcagacgtggccctatttcagctctgcggaatcgcgacatgcaatgaaaaatatgtctcctgtccctgtggcgagttgttggaatgggatgggtatgctgaccccgattctataaagtgaataaactaacacatctccagtggcgatgcctgcaaatccattcatcgccagctccccacttcacttccgaggtatccccgattccctagcggagtatcatcttgaaggctccgagtgctgtcttatccacacagacaacccactgtcagtggaaaagggtgtttatttgaaccctttggtgagggttgggtatagtggcgccgcatatacagctacgcatccgatgatgaactggctgtctgcgaaacggattttacaagggctgtgggttaatcgactacgccggttgggtatcactacgtggttgaaagaagtagtagttcgaaggcggatagacagctggagagtgtcgggtgctgggaatgaagagcgtggggaactttgcattattaatgagatgcaaattctgcatcgatacggatgggcccatgtgtaagaagagtaagtgacgttgtttgataaatcatctcatgttgataaattgtattcacttcggacaaagtatgtatttgagggatggagtggtgcctagtgtggagatcaagttctgcaagaggctgatctacaatgtgtagatagatcggctactaatatactttgaactgcctaacataatacaaaggagacatcacaaaagaataagggtgtgttccgtgggaccgccaatggctatggagtattcgtgcgcacaaatactcagccatgactttatgcaagggctcgcacgagaactggagtttgatcagggtgcgcaccggcatacggcagatctcgacaatggtaatgttgacatctccgtagatataagcaccaagtgccgggaaccctccgcctacgctgtctctgggggctacggagagacattgtggtcgagagggttggggagaggaaaaaggaagaagagaagagggagaaaggtggaagtctttttatacccccaagaacacgcgtgccttcctaaacacgacaacagtcgtaccttcccaaacttgaaatcttgccctacatacctaggtagggacctcgggagggctactcagacagtcagctgtattttgtctgcatagtacctaggtagagctccacggtgagacaatgctgtcaatatacaaaaatgatatttaatatcttttactctatcagagagacacaaacccccagtatctgggaacatggtccacatttagtctaatacccacttctcaactcctcccagattgactttttatacccccgaggccggcccaaagcgattatgtaaccccggcaaatcgccccgtttaggactgtatcaaacaccaaaacccccacttacctccataaaccacctaaatccccaaaatacacataatggcaacaatccaaatcctagacggaggtctgggcacctccctgggcgatctatacaacatcaaattcgattccaaaacaaccccactctgggcctcacacctgctagtcagcgacccagcaacactgcaagcatgccaacgcgacttcggcgtcgcaggagtagacatcctcctaacagcaacctaccaagtttccgctgagggttttgcacgcaccaaaaccgcccaattcccagacgggatcctgcgcagcgcagtgggacctttcctacagaaagccgtggacatcgccgagcaagcgaaagtgcgcgagagcgcaagcgtcgcgctcagccttggtccttacggcgcatgcatgatcccaggacaggagtatagcggtgcatacgatgccgagcatgactccgaggagtcgttgtatttgtggcacttggatcggctgcggatgtttgctgaggcggatggggagcttgtgtcgcgggtgcggtatgttgcgtttgagactttgccgcggcttgatgaggttcgggctgtgaggagggcgattcgcgcttctgctttccgtgtgccgttttggattgcttgtgttttcccgcgcgatgatgatctcttgcctgatgggagttcggtggaggaggttgtgcgggctgctgttgcgtcaatggagggtggggatgttccttggggggttgggatcaattgtactaagatgcataagcttgctgggcttgttgatttgtttggtcgcgctgttgcggaggttgttgcggaggggcaggtatctgctccgccgagtttggtgttgtatcctgatgggacgaatggggaggtgtacaatactacgacgcaggtttgggagaaacgggatgggttgggtgacaatttgagtgctaatgtgagtattactctctggtgggaatgttagagtactcaggtacaattatgctgacttgaaaatttagcgaccttgggaggagcagttggcccaagtggtcaatgaagcataccgaaagggccatttcacttcgttccttgtgggcgggtgctgcaaagcttcccaccacgatatcaagaaacttggacagcaattcaagactcaatagaaaatttaagcggaacacaaatggtgttgtaaatgcagattgattggaatgagatattgtacatcgctaatgttgtcgctaatgttgaatagccagctaggcatgcaaatatttatacatcataaagtcgtttaaaagagccaatcggtgaacttcgtccacgcattgttatgcgggttttcaaccggcatgatctccccatctaagagacggcccgaccacaagtcgatattggcagcacgctcaaactgtgcattcaacatgttagcaaatctttgtgagaaagaaaaaagaataagaggggactggactaaccttggtgcgatgccagagcttccagcaaatgatcggaacgatgaaaatggggataccaatgtacgacgcaacaaagtccgacgtattccagttgcccttcaagaacacggggaaaccagcaaccagagtaattatagtggaaccgataaagcccacccaagcggcataaggttgaaaaggtgccttccatgggagggtgtctcggctcacattttgcctcttcattgcagcaaagaaacgaatatagcagaagcaaagagttgcccaggcaatcaaaccggcaacagtgctcaggttcagaagccagctgaatgcctgcgctgcaccaccgctgccgagactcaggtacgccaggggcccaaagagccaggcggtaataactgccacgtatggcacaccattcttgttcacgcgcccgaagatctggggcaactggtggtctgtagtcatggcgacaatcatgcgcgacccgacccagcagtatgagttaccggcggaccacgcggcgatgagaatgcatgcgttcacgatagaggggagagcattgatgccggcgttagtgatggcaatgacgaagggcgagctgttcgcattctcagagccggagacaaggcctgcggctcttgggtccacgatcatgccgatgagaagggctccgagaatatagaagaatgcaatgcggtaggtcacacggcgggcggccttgggaatagcacgatgaggatcaaccgattcggatgcagtaataacgacagtctcgacaccaatgaagctgaacgaggcgttgacgaacgacgacaggaaaccgaggaagtggcctgttggaccggtgataccgttgaagtttgtccacggcccggggttattccagtagcggaatccaatggcgtcgccctgaggaccgccgcctgcagtaatgacaatggagacgacaaccaagccaaggaagcaaagaaccttgacagcacctccaaagacttcggtttcaccataaaatcgcacactcatcaaattgatagccaaaataagcaccaatccaacagtgatcaccacggcaggcgttatatccgtccaatatgaaacaataaccgcggcggccgagacttccgacgcgatggcgattgtgtaacagtatccgtatgaaatagcgagtgagaaaccaacagctgggtcaataaatcgagtcgcccagtgagggaaagatccagcagtcgggaaaagcgttgcgagttcggcgatactttgcatgacacaccacaaaacccctcccacaacaatatacgcgagcagcaagccagcggggccagctttggcgtaggcagcgccagttcccacgaacaaaccagtgccgataccgctgcagaagccaatcatggtgacctgataattgcgcaggcgacgctgcaaggccgcacgaccgccgacattgagctcaaactccgccttgggattcacatcgtattcttcaaaatctgcgcctggagccggctggacattgttattgtggaagccggacttgtccatgttgtcgtgtgtggtggtggtcatccgggccaagtcttccccgtagattataccccggagacttgggaaatgatcaaagcgggttaggtgggaaacagctccctttttcttccaaaattattcagtcgcgtccaagcacgacatcggccctgtaacgccgatttgttctccacagtggggagcctcattgggcttcatcgcccggagttcggcctctctccacttttatgggaggcgattgactaactttttcttctttgccataatcgcaagagaaggcgaattatgcgacattgattggttggcttcatgtcatctcaaggcttgttggcatattgcaccaataagcatgatgcccactcaattgtgttttctcccaggtaccaataattcgagacgcaatgaaagctgtatgcgtatggaaggatgccacgtgatgcgccggatagggttccaagaattcaaactttgggcctgagatcctaggcatttattttctttgcctcaggccttgatatagcgcggaacctttatccgcgggttattatcctaattaccctatagttagtcgtagggggccggagaaccgcagggtaaagcttttcatcaaactgaaaccatccatataagcaactagtcctcctagagatatttgtgttgctttaatgaccacaagggctggtccttctataatcgatcttgtgttaccactttgccatgaaggcttaccgctgatattggcgatacagcggcaatgcggtcaaccgaggttctaacggccttaggaagtgcaattagcaagacgcaccctatctgtactttcagcgtgccaagtgccactacagagagagatgcagattttcatataaatcgactgggttagtggacttcaagtcacatcgaatcgcatatcaacctatagccgattgtctaaatgctctaaatccttacttggactgcaaaagacttcttaaaaatggtatctaaggatctagatattcttaaacggagcatgacaagatcttttattcggaacgaccgaaatgtgctcgagcgccgaccttaacagactcgaaggcagattggaagtaatgcgaagtctaggtaatcgctagcgcaagccgcacactggttaaaattaggggccctgaagaggcacctcacacggccgagtcagccctgtcgtcttttccaatagatatgcaaatacctggtggaagacacgacacaacgactgcactgaaatctctcgagttaattctgcctacccgtaagagattgtcagcagcgactcagaatatctaccgtctactaactttctctagccacatattctcgccgacccaataatccaaccgctcctgtcctggccagcccagaaggctcattagattgtctatgtggggtcgcctacgatagcgaggaggtggaatagaagcagtccgaatggaatatactccgaatcctaaagtcagacctgagttgtggcccctgtctcataggcagagtagcgagcgggagcctccatgtgacagtggtgaatgttcaatgcaccgccacagcagcatggccgcaggtactggtcatgtgataacagccacaggcctgttcatgggccaccacgtgggttgtaaacagattgttgtagccgcccacgaccttcttccaactccttacccctcaccagcgcacacacactcaagcccctcgcaatggtctggcaaccagaaccgctgccttttaccagcaactcgcttcctaaatcccccttaccgagcaatgatgaaatccgtgcttgcacaaatattctcttggatcgcgtatacaaggtagtcgcaataaatgacgagattgtggtgaaattcggcggcggcgtcaaagaatacgagggccaggtcctgctatttctcgagcgccatctccccacaattccagcgccccgactgtacgctatgtataaggaccctgagacgtttgaaacgttcctggtcatgcagcgcatccccggcgagccgctggacgcaatttggccatcattgaccgaggacgagaaagacgatattaccgataaactccggcagatattcgataatctccgacaggttccgtgtcccaagcccgatttctatggcggcctggatggcggctgtctccaccactacatgtttcataaccagaggggcggcttgccgagatccttaggaccctatattggggaagcaaacttcgtcgcgggcattgttgggaattaccgcgtgtacattgaacggaatcagaggccggactataaggtccgctactacgaagaatatctgccgagtctcctcaaggggcatcggccgacgctgacgcacggagacgtccagcagaaaaacattatggtcgcagaaaatagtagcggtcgcaatgcgcaggggggacggtcgtttgatgttgtgatgttagactgggcggacgctgggtggtatcctcaatactgggagttctttgttgcatcctccccgattgcattcatgtactgggatactgactggtgtttaagaatccagcaattccttgaggtttggccagcggaacaggccgtaatgcggatgctggaaaaggatactggtctgtgacatttcaagagcttatagataatacaaataggcgtcttgtgttgacaaaacaagtccgctagccaatcaatttgatgacaaaaattgagtaataaatatccgaaacatcttctcccgccttacatccagacatccatagacctgaagcaaaccagaacctagtacacgtctctaggagcgcgtagtgcgcagaatgccagcattagtcaacgcggggatggccagctgatgcgtccattcattacacttaaagatcggtcgccgctgctccccaggcccatacggttccccattttctttggtccagatatactcatggtaaccagatgccgggcccttcccccagaagttcaatccctgctgcttagacggcgtcggcagagccctcaacatagcctcgattcttcctgatctgaaatccgcccgtggaacccacccaatctgcgggtagctgtgtagatgggcggagacctccgctgcatacccttccttcatttcaaaacgcatgccgcttggggcgatgatgtcgcccgtgacgtggaacattattccatccttggttatgggattgtcttcgacaaagatgccttcgtgatagcgcttcggcgggtcgagagggtcgaatgctgcggtgtcgaaggaggggttgaagaccgcacaccaatcactctgtgcgctggacatgttgtctttgccgtaatggggtgtaggctggtactaatagatggtggactgcgtgtagtcgacagaggctaggtacaatagaggcaagagtacaatatcagttgttacgagtctagagacacatggaaaatgtcagacacagcaggtacaccccttttataacccagcgccatcttcttgttgctaatcatagacaaccatacctcgcacacagattcaccaggctcatactcctgtctgggttgattggcaaaggatgatccgtctacttggacggcttgcagcgccagatgagacaaggcactcgcaatcccctcagctaaccattcatttcaagttgttggaatttggcgccgtagggttgatttaggcaatcgctgcagtgagggtgaatttcccagatggagtagacagcgcttaaatgagccagcgctgcgtaaaacaaggctcttgcagcaccgccgcaatctactggctgcacgtctgccacgtttcttgcttcactttctttgttcccgaaccgtgcggctgaagccccaaaggggaagtggcgctacctcaaggccgacttcacccgctggccggcgcttatgcacgagtggagctgcgatacagctcctgtgccgctttcgttcgtccatgataagctctacaatgtaaacgagataatgaaacgctgtacagagtggcattgtactatgtgacagagctctgtaaagaggtgtgggaaaggaagaagagtaggagtgaactatgcacatggggaaaggtcatctgatactagtgagatttaaaagtccatgacgtggcgtcggcggcaagcaacgcacataggtgataatagtaaaaggtcgtgataatagtaaaaggtctcagttgagcgtgtggtgcatcccattcaccgtgtcatcgttaagtgtagtagtatacaatagaccaatctaccttcaattttcccacgtaccctacaacattaaccttgcggctttgtggccctgtaatttccaacaaaacactcaggctgataccattttggtcaatgttgttttcccagccatattttaccccgcaccttcaacaccgcagattttccgtgaactatgccgtggccatgctgctttccattcaaacagggcgaatcgaatatcgcgaggacagtaagaaccctatataatgagagtgctgcatcttgttttgtcgatgtaccaatagtatctacagccttcacttccactagacgaggagactggcttgaaggtgctgcatgacgggctcagcccaacagtcgagtttgtacaagccatttctatcagacattccgataattaataattaacacagcatcatctctgtccatggtctgaatggccaccgcgaaacttcatggacggcagccaatggggtaaactggctccatgatctgcttccatgtgatatacccgacactcgagtcctgtcctggggctatagcttacccaccgcggaaaacaaccatgagacattatcccaacaggaagtatctgagcagctagtccgcgacttgtgggaaataaggtcatcaaccaacgcacgtactcaactgacccaacaagacaacaagaattagcactgacagagacagcacagacagtcgatcgtccgattatatttgttgcacatagtctcgggggaactatagtcaaaagtgtaaggttatcaattctatgcaaaaagagaattgtctttgatcagtgccaggccctgctttatgccgactcaacccctaccacggaccttcgcagcgtcagactctcaactcgcggggcaattttcatgggcacaccagagctagattcaaggctcattggactgcaaagctacttagctaatgctaaaggatctgagcaggagtctagcgatatttataaggaagcacactggttggtgactacattacagagttacccgtcaatcagtcaacagttttggactttatttgtgcatgaaagctccgactctctatcagtaaggggcacattggaccaggtaagagcattataaccagccagtcgtggactatttgcttatactagttatgttggttttctttgaacaagactgcgtcgttctcaccacaggataattcgtcacatgtttttgttgaatctgatcataatgggatgatcaagtttgaatcatcgctggacgagggatatttgaaaatcaaagagcatgtggttcacgttcagaagatgctgcaacaatcaactgacacctgaatgatcaggccataatacaaattcagctcccgaggtctcatcgaggaaacacactattagcactattagcggattcttattcgacacgaacaatgcagccatagattaaggttattaattgatacatccgagggctctcggtttatttctccgtagcctcctcaataatagggctactccgtacacactcccatcaatctcctttccttatcttctctcggctcaaacaagcccaatctgggagaggcgttcaatagtcggagctgaaactgatatacatcgtagaattatctcacaattacctaacgggtgcagtgccattggccctatggactgagacaagctgtcaacgccaaggcttggattttctcgcaatttccgcttccgcacccacgcggccaagcgccaagtctcatcatgataatgcatggcataagagcgtatgcaggatttaacaccgatccaagacagtaagcagtaggctagatgtcgatcatgtacgggagagagtaagatccgactaactaaataatgaccgcttaagtatacggccttgtcatttggtagtgtttttggtggtatttccatgtcgttttttctctgttgatttgccccttattcgtcctagctagttacaaaatgtagaatcgttaaaaataaataaaattgatatttacatgtgattattgaaataatcctgtcaatagtgccgatcgtccctgaggttgttttcgcccgttgtgttggtcgaagacggataaaatctcgtctcctcattccctcccctttcagcgctaggaatgcccaattatatccaaccctttcagtctttagctaaattatcctcctgataatcccattttcttggttcatgttggaatgactgaaacggaaccttctcagcgagacgcccggccggaggcctccccgctcggctctaacggggaggggtctccctcacccgcaaaggcagtgccggctcccaaggccggaaggaagctaccaggatggcttgatcatttcaatgcccgcgatcttaaggtgctattccgttgctcactagctgcgtgggtcgcgtcgctgttgatctttatcacgccgtccctaaccgtcattggtaccgcgacgttctttgcaacgtgagtgtatccatatatctcctttcggtattggtttgctaatcccgctgttatcagtctggtacttttcatggtacctccgaccggcattgttttcattttccttttaggaactttgaccctcgtccttggcatggccttgggctgggcctggggtgtcgtcgccatgaaggctgctatggcagcgagaccggcggctgagacccaggccaagcttcaagccctgggacaggccgcatacagccaggccaattccactggacagcctgtggcagctgtccagcagcaacttgtctacaccggctggatgcttgatgctcgtgtaacagctgtctattattgcctgatctgtctgttcatatatttaattgtgagagttcttagccccagcgtaatcatcgtgacactaacccttttgtacagtcccgtcttcgggcgacgaaccccaaattcattctgttgcagattttctcaatcatcatcatcgacgttactctgactattggcccgctgcttccatctttcagcggtaccatccctaaggttctgatcgagcctgccgctattggaattggcttgggcctggtctcccattttatcttcttccctcgatctacctcccatgtcgtgcttgatggcatggaggggctggtgcggttactcaaagggcctctggatgccacggagaacagtcttctgaaaggtgaggacttggatatggcggatctgcaaaagatcaaaatgaagtccattgctgcttacaaggctctcaagccggccatgggctttttaccattggacttctcagttggttggtggggtgcagaagacatcaagagcatgaagaaaccaatacgccaggctttgatgagtagtctgtcccttctggaagttcacctcgcccgcctcgggggatacgcgaagctggaaaaattgcaccagctcactgcggatcgtgattctgattccgattcacaagttgatggaaatgagaaaaagcgttcacgggaggtcggcatgcgccagctgatggagagtgttaatttggtacaagcactacgaagcccagaacatgaatccatgcggtcagaaactatcgacgtattgcgcgagtccagcaaggatatcctcccggcatgccaggaagctgtcgagatcgttgcggagtccattcacactgttaacaagcgttggttcggtcgcccttccaaggaacatctcagtcaattgcacgagcgtagtcagaccgcgctgcagaatcttcaagccctgcgcacgtcgtttgcgacggagaccactgaacgtctgattcaaacacatgcagagatcttcgacgaaaaaggcatgctcaggactttggacgaatcatcattgcccagagttagaggtatcacaatggggatgatattcgaagagcaggtgctcggtgtcgtcgatgggtgggagcgggtccttggacagcttgttgctctcctgggggcacgccagaagatccgtctgtggttacccaagggcttgcgatatgcagtcaactggattcgtcgaaagaatgccgtggcgcctgtaatcgccgctcataacccagttatcgaccctgaagtggaagagacgcagtccaaagcggcacagcagcatcttcgcatcagtagagggtatcgtgtcaaccgtggcagccgcttcggacgcgccatcattggcacctatcattggtttatcaacccggaaggtctttacgcaatgcgcatggtggctgtcacgattgctctcgctatccctgctgcaattcctcacactgcgggtttctattaccgcgagaaaggtctatgggccctcatcatggggcagaccacactggtcatatacatggccgacttcaccttctcccttctctgtcgagccgttggtaccattgttggcggcgtccttggtttagttgcgtggtatattggctcaggccacggcgagggtaacccgtatggtcttgctgccatcatggctgttgtgctcacgattctcatgtggggacgtatcttcgcgccccccgctatgcttcaagctatgatgatggctggtgcaacttgcattttggttgttggttacagttacgaggatacgtaagtaaattgtactactttgcggggagcaacatgactgacacacttcccaggcacatcccagcttacggcaatcccggttggggatatgatgttttctggcgacgacttgtccttgttcttatcggctcggcagcggcactgattgtgcagctcttccctcgtccaccatccgcatcgggccacgtttgcaagtccctttctaattccatccgcttgctgtcggaccactacgcgctcctcttatcctgctggggacaagggcgcgaagaaggcctggccgcagagaagctggctctaaacgtcgcagagactctcgccgcactggacgggcccatcgcattgctgcgctttgaattttccagctcgccatttgacagcgagcgtcttggccaggtgaaagcgctgtgccaggaactcaaccagaacatcgctcgcctactatacctatctgcttcgctgccagaacacctgcagagccgactagctcgtcaggctggtcttcttgaccaccacaatatcggcgatgtcatggctgttttaggcgtggttgaacagtcactgaagacgggtgaccctctacccgaggtgctgccaacgccactactcaaccgttgccacaattactggatgtcgcaccatgtggatattattctgagcaaggatttgattcgcgacgaagagtaccgccggttctgcgtcgccatcagcgcatacctcaaattcctggccgccgtggatgacctggtgctcgtgatgaagggcacattaggcgagtcgcatatcgtcagccgcgacctgttggacgaccagtatgtataaagagtgtaaatttctgtaatgataggtgtgttgtgctgggagcatccgtgtatataattgcgccgtatagcgatgtgtcataaaaattggttctcctcattcctccgcacgcccgattttctccaatttttttcttcccccaactctccaaaaccatcctagcgcctttaaatgtcatgcaatattttgttttcttcctcttggtctcctctataaatcattaataactctaatcttccaaaaccgactgcgggtctcatcccatggccactccgcgtctcgcccgtcttccccggtggatcagccactggcttggctatcgcccagagcccgtgaagccactctctacataccaagtcgctctctggtcgttcataacctcattctgtggtctatcagtcgtacaagcaattttcaactactccgactacttcaccgagcgcaatgtgccagggatagtcgcctcctacgtaagtcccacgccacatcaaatgaatctcaccgaaatatctacattgactcacaaaaaaaaaagggtgcatccgcagtcctggtcttcggcgcaatcgaaagcccactcgcacaaccgcgcgctctaatcttcggccacttcttcagcgccttaatcggcatctgcatcacgaaattgtttagtctgatgcccgaccagacgcgcttcgagtccctgcgctggctggccgcttcgctctcaaccgctattgctattgtcgttatgcagttgaccggcactacgcacccgcctgctggcgcgacagccttgctcccagctaccagcccggagatctggagactttcttggtacttcttgcctgttgtcctgttgtcttctgttatgctcatggtttgcgcgctgctgtttaataatttgcatcgtcggtatcctgcgttttggatcgcgcctgctccgcccaagcctgttgcgcctcctgcgccggtcccggtgtctgttgatgtttccttggaaggggagaaggctgtgaagagtcctgtttgatttgggacgttgcggtaagaggtgttcgttccgaatgaccttgcattacacttcgggtgttgttacacggtatatgccgctatccgtttgctgtgagatggtgcatgatgtatatataaactcggttgcactactaatactcgagatctctataagggaaatatattaattactattttttcacgtctaacatatgtatttgtaatattctcagtcgtaatgcttcacatcgtaatccttagaagcagctgcttcttagtagcgatatgctagtcctctaatttcacgctgccaagtacctctagagatatggtgtgggaagtgagcttggtgcagggtcgtatgatcgtatagtaaaggctggggggaaatggaaagctaatagacatcgtatatagacttgacgctacgatatgttccccacaagttttatacagcctcctactcagggttcttcatccggtttacgactcccgttcggtctgatcgtgttggtggatatctgtttcgtctctccgtctactatgtttgtgctcgtttattcaaactaaggtaactttttagggcacgtttttcactttcctccccaccgttttcatctgacttccaaggttgcttgactattcttctacaatttggatatccaaagaacaaatcacaatttcatttcagtcaaccgaaaaatttgtgcaccgctaaacagagaacaaaaggtatcgtaaatgcaaaagaataagcagacatcttggtatcataagactgacagaaaccgagaaaatcctcgaaatttcagcatcatagaaacagtgaaatacccgggaaagtgacaccacgagataaaggagaaccatggagaaacgctctcacgcttgctcctcgaacaaaatagcagaccaatcgctgtcgctctcatcggaatggggaagggaatccaaaggggtaggcttgcaatattgcaaatatcccaagcactgtctgaaatgcagccatagccatccccttggaatagaagcgacacaagaaccatcgagaattgcccgtctttcatatcgttctacacaaactccatcgcccaccgatgttgctgcatctcaaccatccgggcattctccgcagcttcagtgtcctcgcccgcgacaccatgaatagtgaggcttccaacttgcatagccagcatgccgagcagtttcataccgaacaaattgcaggttttggcggtccgggtttcatcttcatcgtaaaccgcaaaccagttcatgtttccttacttcatctctcctagcctcatatctaacaccgtctatgctatactacacaataatgttttactgaaagtgatattcgttgttaagttatcccatcgaaggcctctattgtgtcatagtaccgtaatgagcatacccaacccactgccagctccattgatcttcatcatgtcttgaatgatcctccctgactcggagatctccatttagcaagtcaaacataaaacgcccatcactgtatgaagatagatcaacatgcttctgaatgctaagtcccgcttcagtagtaaccatgaatctccttaaggccgcctttaatgtctatggactgctttcgctttatctccgccttatcgttcctacatatctaagtagtggaatgccctacaagtatctagaggaagtggcaataaacatatttttgatgctaagttccacttaagtagtagccacgaattgcttcgaggccaccattaatgtccatcgactgttttcgccttgtttcggcttttgccgatagcactactcgtgatttcaagttagcataatgcaccacaaatatcgtcagataggtagtaaacatacttgtggttgtgtatgatggagattcggagggtctgagctaatagagagcttttgtttcggcttttgcggagattagctactcgtgatttcaagttagcataatgcaccacaaatatcgttagataggtagtaaacatacgtctccaagtcggtggaggtcccgatagggacctgctgcacgataaacaagaggatgggttgggtccacttaggagttccgggagatccgctttccaccagttaggttggtaaggtaaagcttttagtagtgtaataagacataccctttgggacctcaggacatagtgggacatctgtggatgatgatattagatgaaggctttgatgaaatggagatgacgatcatacttgctgactcaagaagctgaggatgataatctcacaagaggatagaggtgaaggatgaagaaggaaggagagttcaattggggaggggcaggccttttatactcgagcattacgcgcgtcaacgcgcgacttgcgcagttgtacgcgtccatggcaaacagatcaggatctcctaggtatatggggaatagtgtaggggaaacaatgaatgcaaggagggtgatcagtgaaagaattcaagcgtttggcttcgggacacgagttagtggtttaaagcgagaccttccattctttacctcgacaaacattaagcatagacttggtgtcttagagctatcaaactcgtaagtggagctcaatcatagcaaactgtccttgacgtttaacttattacgtaggaattggggagacattggcttagagacccccagttgtctatgaaatcctatcttttggagacatgcacctgtatataggtctacgtataaaaggtcaatgggctaaatgatataatggatatataggaaccatcagttaaaggaacagccttaaaatttaggacatgagtactttatttgaagccaacccttgtattctttacctctataatatcaagcaaagaccaagtatcttggtattgtcagtaccacaattgcaattggaacccatggttatagatagaaagctcctctgtgtgatttatgctctttacggccatcatatacgtcaagaagattttaaaaatgaacactgaaaagcatgttggcatgttcttacatttgtataaaattcctcatttcatcttcgatgtgggacgaaataggtcggattattaaaatcttatttcgtcaaggaaacggaccgtataagcggactattttggttataaaatctgtctcatgagccctggagacacaggacctaggaccaaaggctcgaagcaaacaaataagcgagcaatcaagcaagcaaacaagtttgtttgctccggagacgcgtctaggaacaaagaaagtatagtcgaaatgtcacagggaatctataaaagccatcagcaaaaggatcgaaacctttcggttcgggatacgaggcccttatttggagccggaccttcaatccattagctctacaaacatgaggcatagacttagtgtcatagtgttgtcacaactataaggagggatccatcacgacaaactgttgtcgacgctcaaccaatcataaacgaattgggttagagatcaactgtatatgataccctacctttggagacattcacctacaattatgactacacatttgacgattaagtcttagacatatagcgttgaacgtattatattgatatcaaaggagaacgtgggcgtagatgtagtctttgccctttcccgaattctactctggcacttcttcacggtttcctcgccatataaaataacaatagaatacatctgttcgctcgaatcaatacccatgctcaagacatcctggcttagcgggatgcaattgagttggccattgtggatgttgacccggacaagaatgtagatgggcattgcatcactaaatccacatatagatgattgtacagctacagtagggcctacataaaccggagtcacacagataatgctatagtacttccaaggttgtgacgtgtaaggccctaccccttctcacccgcacgaaattgccatagctaatgagcccgagtcggcggacagtatattttatcgttgaaaatatctcgaaagtcacggtatccttccagtgcgacgtcagtttcttttcttatgaatgcatacggttcgttgtattgctatattgaataatgtctcataacaagttcaattctatcaggcaaaagaaggctggagcttcccacaggctcggtctgctaatctctctttcatgagcacctcatatacatgcgatgcccatccacagcacaccttccgcgtatccttcgggtcgataatttcctcaatcccaaacgcattcgctgtacgaaccggattcatcagccgcaggtactcctcttccaattcttgataccgttcctccttctttccaaccttctcagcttcacgcagctcatgccgatgcccaacctcaattccaccatccagaggcaacgaaccccactgaccagacggccaagcaacctgcatagacggatcacgacaacccaacataacaccgccggccacaccgaagacacgccgtgtgaccacactgaataccggaacagtagtgctgaagtaagccttggcgagctcaacaccccaacgcattgtcgccgtgcgctctgcaacagttccaatggcgtaacccgcttcaaacatgtcagctcgtttcaactgatctaggatgaaacggtatacttacggacgtccaaaaactgcagaacaggcagattcatcacatcacacaacttcagcagccgcgttaatttctggctgccagccgcatcgagtgcccctccattcacttcgcagttcagagagacaatcccaacaggacgcccacccaggcgtgcaagtccaccgattgcagtccgtccccataatgctccgatctcgaaccacgagtctctatcaactacagacgtgatgattgagcgggcattgtacatgcgtgcttgtcgtcgagggatgatactccgcagtgcaatatcctcgcgctcctccgagtcagtacagggtattgttggcggcgcgtcgctcccactgtttggaagatagctcagaactacccgcagctgctcgaagcattctgcctcattggcagcgaggttatcaatcgtaccattcatacaatgaaccataggcccgcccaagtcttggaagtcgagaccttcttcgaatgtcgcgccctcgacaaccttcgggcctgcattgaacagtgctccgatatcagctgccatcacggagaagtgacaagacaccactctcgcggccccaagtccgatctacgcgccggtcagctcagcttgtatcatacaataccaaatggattatcagataaaagcaaagacgaaaagaaaatatcagatacaaacttaccgcaggcccaacaacagcccccaaattcggaatccccatattcaactgctgaataacatacggaaaggacgcaacatgtggaagataactccacccctccttccgaattgtcgtgacactcccaccccccgaactcccatcaacaagcttaacaaccggcacccgcagcgcaatagcaagcttctccacgtagaccgtctttccgtggctcgcgccgtctgcatgtccagaccggatactgaaatcatcagccgtgagaaggaccttcctgccgcggagaagtccggcgccttggatgttattgctcggcacgaaagagacgggcttctcgcgcatcggcgcggtcttttgccatgtcactgtgccggagacggagccaatctcttgaaagctgttggggtctaggagctgctcgatgcgctcgcgtacccatagcttgcctgcttgcttttggcgtacgtagcctcggttgttggggtctggttttgcggctatggcgcggagggctgagagttggcctattacgtctgagtggtctgctgggaggcggttttctgtagactttgactttggcttcggctttcttggttggccttttggtggggatatatgggatgaaacttggtgtagacggtcggtggcttggtctctgcctgttctggtcggtgggttgtcgttgtctttggtcatggtgtatcaattgatatagattggtgtatttcttttattttcttcgactacagtgtacatacgtagaactagagatgtttaagggtttggtctactgagggggtgggcagaccgagggccgaggtcgcccgcgtcgagctataatatcttgttcaatggtgtaagtatcttgcaatgaaatattaaagtgtctaactaatctctatctgaaatataccgtagattatttcgtttattggctttcctcgtgcctttgcatacaattaccccggatttttccccttccaccccaaatgtcatccccgcacacacgccccatcaagcgattgttggttgccaacaggtatgaccctctataacacaataatattagaaggtgcttactttatattttctagaggagagattgccgtccgtattctccatgcagcacgagagctacccgagccagtcgagacaatcgctctctacacatcagacgaccgatcgcactgcgatctagggcgtccacagaatgcgatccaaatcccatcagcatcatcatatctcgacatttccctcctggtagagctagcccaaaagcattctattgacgccgtgcatcccgggtatggattcctcagcgagagcgccgacttcgcgcatcgcatgtggcatgaagctggctctctcgtcataggacctggatgggaaaacctcgcccgaacaggtgataagctgcaggcaaagcatctagcgcaacaatgcggcgtccctgtactggaagccatgagccaacctaccaccagcgtggccgaggcacgtgcgtttgcgactcaggttggtttccccgttatgattaaggctgttgatggtggaggcggtcgcgggattcgccttgttcgcgaggagcatgagctggataatagtattcagagagcgattggcgagtcgccgtctcggactgtctttgttgagaaagctgctgtggacgggttccatcatgttgagattcagattattggtgatgggacgggtcgggtgcgacatctgtgggaaagagattgcagtgctcagcggcggtttcagaaggtggttgaatgcgccccggctttggtgcgggatagagctttggtcggtcgagtgattgaatctgcgctcaggatggcaagtgaaatctgttatcggtcattgggaacgtttgagttccttgtcagtgagcagcgtggggaattctacttcttggaagtgaacccccgtctgcaagtcgagcacaccattacggaagctatcagcgggatagatctggtgcagacgcagcttcttctcgcccagggatacactttgcatcagctgggcctcggtgctgaggtcaacgcaagtcatcctcccccaaatgccttttcaatccaacttagactgtgtgctgaagacccgagcaacgggtttgctctaagcattggcaaagttaccgggtttattgttcctagtggccacggaatccgggtcgatactcatgtcaatgtctctggccccgcactggttgtgggatccaatttcgacaatctattagccaagataatcgtgactgcgcccacctgggaagcatctgttagaaaagcccagcgggtcttggctgattctaggattgacggtgtgaaaaccaatatcaatcttctacgggggatcgtgggccatccagatttcatggccggcagagtcgacacgcaatggcttgggctcaacctcgacgccgtactccagcaaggggagaacatatcggagactctgcgggaactaggtggtcccgccggaccttcacagcaagcggtctcccaaactggactgccagcgtctaatctcctgttccgaaaaggagatgcatggtcaatcacactggaacctctatcgaaggattctcaacaatcagacaaagtggcccaccatctgcgcctgtctcgggtgctgcgcaatgagttcccaagttccctcactgccgaaatcgaatatacgactccgacctcacagggcgcaatcccgtatcggatgcagctcgaaacaaccacgactgctgcatcagcattggtatcctcgtcgcatcgacgaggtaatccaaagaatcctcaccatatcatcctacccctttctggcaaattgattgagatactggtggctgatggagaggatgttgctgaaaatcaggtcctggctttcatcaagcagatgaagatggagctcgaagtacgaagcccccgaagtggtcgggtcaaatgggtttatgagatggaggatgaagaggaggatgtcgctgaaggtatgcttttggtcgaactggagccaaataatggcaatgtggaagttcggggtaagttatgattctgcgttgtgtagactatagaggatatggcatcggtcccctctacaaatcaaattcaagagtcccatacatcaccaacgaatcagctctcagattcgcctggtcctccagcatcattggtctagtggtagaattcgtcgttgccatcgacgaggcccgtgttcgattcacggatgatgcacaagaatttctttttgctttttggctaaggaatcatttaagaaattatgctgtagtctttgaagatgtacggagcatgccctggatagtccgaatacagttggtttgggacgatataaagacgtgacattggtctgtttttcttgaaaggaaaaatatatatatttttgaacgtcgttttctatattctatagatgccttgctagatatatttttctaccctttagatattcaccaatgtttatttaagataattcgtcgcaagtattgtttttgcatgtatcagatggtctcttcctcagaccaaaatccgaattcgagttgtgcgtgtttacctttggcaggccaaggcaggcggtcaagaaaaagcggtcacttctccatgtgacgtcaccgcctcagcttccccatcctctactcttctgtctcctctggcttgaaccagagtaaattctcaggatggatgccctcggtgtctatgtgctgacctttaactgtgcaagaaacgttgccgatgtcgacgtgttcgcgaaccacttcttcgacgcactccccgcgtctggtgcggggagctccgcacccgacctgattttcctctcgctacaagagatcgcacccatcgcctactcgttcctcggaggatccttccttctaccttacttcgatgcattccgccgtgccgtccagaaggccgcagcacaaaaatgggaccaccactatgtgaacttcctcaccgacaatacgggaatgacaggcctgatgcttttcgcgcgcgatgacacccttggcaaaatcgcctggagagacacagctcacgtcggcctcggggtccaggaaatgggaaacaagggcgctgtcggggcacgcctgggatacgttgttgaaggacacccatccaagaccgtggacctcactttcgttgcggcccatctcgctcccatggaggattcctacgagcaaaggaacctggactggaagagcattgttgagcgtctcgtcttctcgcataacagcaatggcagcaagagactagcggagatgtcaagcgtggacgaaaccaccagccttctcgacgatgctgcatcggcgcacgcggagggcagtcgcagagatctcttcgcaccaaacgcctacctattccttgccggagatctgaactaccgcacgtcgaatatcggaccctccattcgagagatcgaacacttcccccgccgcaatgtcgatatcgataacccgtcgcactactcccacctcctaaagaacgaccagctcgtgcgcgagatgggctatggcaggaccttccacagtctttctgaggcgccgatcgatttccctcccacgtacaaatactcggatgccgcgcgtgaagctgtccgccggggcttggacactggtgatcgtgaatgggaatggtcgaatcaccgctggcccagttggtgcgatcgagtcctcttcctcgataagccctcttgggttggtgaagctggaaaggtcaaaccgatcgcttacgatgcactccctctcttcgcacagtcagatcatcgtcccgttgcgctcgttgcatcggtgccactgtggccctctggtgcatcttcaaacactgagaacgtccgggctgtagctccattctctatcgatccgaattggaaatccaagcgagatacggcacgacgaaaggagattgttgtgggtgctcttgcgtacctgggcctgaccagggaaggaaatggactgttgctcgcatcgctgctcggtatcttcggggcgtggttcattcttcgatctatgctggaggtgtgaatggcggtgtggtgaatggcgctcggagagttttctttttttcctttcttttttttttctcagatatcttgccctgtcctgctgtctcttaggtattttcggaagaatgtcatgcaatgctgccagtcgccagaaccggcactggatgagaaagtccagctaataagtcttaccggctgcagtcccaattatgtacaatcagacaatgtcgaagatttagcaacagcctaaactaggcagtacggaccaatgtcacatagtcacatgaaccgagccgatccgaaacggtcatgcattctgcaggtgagaggggttggatttctcggatgaggtcatatatttcttggtttttctccctccgattatcgcctgtttctggcttctccgagaggtccaaggttcccatgactgtgatgactgggctgagactgtacctgtaggtacctaggtagctctgcatacctaggtaggtacaggtctctcattgttcgttgctgttgctgtcatagtaaggtttccacacttcagtctcctccactttgtcacaccgggttttcttattatttttattatttttatttttggctgtgacagtccagatgccgaggtaaaacttcgattgtcttctagactcccaaatgtttctgttcctgaactgtggtccacttacgccgcgacatccgaaaatactgctctttacaaccttggaaggtaaattagatgtgtcacctttaacaaacgtgtaatgcatggaaccacatgaaccggtcaagtgactagcaaggagcttaatttcctctccagacaattttaaagagacacgtctagccttccgtacgaccttgattgccaagaaaaatgtgaagaggtttcatgagaggcggtgtgtggtctaaacgtgtgaagatcttggactgttaggaatccattggatctgacaacattgaagtaagccctgcattttgggcattgcggactactccgtacagatatctcatttcctttggaatgtttctggctggactgaggaaaagaaaaagagggaaaaaggaaaaaaaatggaagaaaaaaaaacgcccgggctccacagcctccacagggatgaaagggagaaaccatacaaatgtagggccaaatcaaagggctattgaattcgattgtttctagtgaagtttcaaggactagaatattggatggtcattggtctatactgatatataagataacgatcatctaatatatagagtagaaagaatagggggttggatatacagtgccaatacataatcaaaacacaaaatgggccaaacgatgtcattgacagggctgatcaggagaaagtggacagcacagaaggatcggaatgttccatgcaaactcacaaacgagcctgaagtggaaaatcgaggaaatcccctgagttcggtggagatttttccagaacaaaaacccagactccatagcagaggcccaagagcccaagacccattgggaatcgaggcttcattctgaaacccggcactctctcgagaatactaaaataagtaaacgaggtgagcaggtccacattatttttctatgttttatgtatctaccaactaaaattgtaggttgtatgttgtacttccatgttcacggaagtcacggaataaatctgaagcttaacggtttggtttgcattaggctgctgtttcgaaatctgctcttgtcagctgctccacctgtccctgcaatatacagatgagactgcgagtcatcccgcgatcttgacgatgcatcctaccgcctgaattttctttttgatggcggatccttcattggcccctttcatgcaccgaagaccagcatttgggccgatcaacccgcatgttcgggtctaggatcatgatcgaccgatctctgcagtagtagaatctactaaatagatgtgtgcaacagtacgacatataacagtataacagtacgtatggagttagtgttatttatccatggacacctagggagtttatagtcttataaagattaccagtattaaaagggaaaaaaaaccgggaagtaccaagggtactcaatgtactcaatgctacctagcaagaagacatagtgattcagatggttgggttagaaagagattaaagaaattaaaaaaatatattgtaaaataatataaaacaagtgaaaaaaatgggtgaaatgggtaaaaaaacagtactaataatactaagaataatataaaacaaaagaatttaataaaaaaataataaaaaataataaaaaaccaacccccagcaaacggtaataaatggaaatgggaataaaaaccctaaaaattcaaaaactcctatttaactgcctaaagaattgtatttgttggcttttacatgtctaagccatctttttgagcctctgatataaacccgtcatcttctccctttcttttcttcaacttctctacttaagtggaatttctaccgcaaccttcaacctccgacgtcatcgtgttgtactacacattctgggccttgatccttattctccgttacatttaatcttgaaaaaaaaagtatctagtcgacttttttctttcccttttcttctctcaagactctttgagaagaattcgccaactcctctttgtcgacatttgatctaaaccccggtcaatatctaccatgtattcctgcgcaaactatccccgtggttgccgaggccgtgtcaaccggcaaggagcgaagtgctccgactgcgttgtatgttatccctaaaaaataatatctttgaagacaaaaggttattcaaagaatagaactaactcccttgacagtctctaaacttgcgccgccctgcttttacttcgcccttcgctcaaccacgcgagtacaagcgcgcgctgccctcagagctctttggcgagctttctaaagcctctgagccagagctgtaatgaatgcaaagctcgcacatcccgggacggtccggagaataacccagctccttgctaggttgcatcctgccggctgggattcacctcgcatgatctacggccgcttcctttgttctttcttatttgcctctcttactctctctctctctccacatctctcatctgcatcgccgggagtttctttgttatatttggcgacctgccatttgctctgatcgcctaatttcctggctttctcatattacctcacctcttcgatctcgtctgaactccctacattggccgggctaatgagtgagcttccacgaatctccttttgggaactgggaaacttggcatggacttcgcgaacatttcctttttcactcgcttgggtttgtttctaggacaaagaacggcccgctattctgttttgcatggaggatagatcgcattttctttttttgcatggatacctacggacatggatctgccactggagggcagtggcgctgatggattgggttctttcaactctccggttgatcgttgatcgaccccttcttttccttgcgcatacgtgtgctttgatattcttttgtttttggtttttatgccctatttttatgttcttttaactgatgttgactctttcctttgtgaacggtgatgccatacccctctgttttacttgcgctatcatatgaccattccccctagtgctatatccctatttacagcattcatactgttatgtcttgaccttctatgccatctcatcttatccttgtataatctagaactagatcagaatactcagccctgtcagcaaagcccctgtattcccaaccccgacacccacttgcctatccttgcagtagcgtgttcgggcctcgatggacatcccctcagccccagtgtagtgccactggggctgtgaagtttcagcccccaaacacccctctcccagacccgacgtggggatccggcacccggctaatcctcttcgctaacatttttcagccgcaataactcccgcgtctcacattgaaacagacatccgagcgccaacataccaaaaaaagaaaaagaattcgcatataccccgaagtttagaaatctgcccgtgcacacacctcacccatcaccgctgactcaacaacacctcaaactcgcacggtacctaggtaccctcgggtacccttcacccttcacacagcccatccatttccatcgtcgcatcaaccccgcccccgactccgctgcgcaatgccgactccaacccttgtaactaaatccccgtcacgatctagactcagcccgaatctgtagatccgcgccttgtcgatgcacgggtggcatgctttttctagtaagtggccgcgcgacgttgcacgcgtacgggttaggcaataaaggcatttgtgcgaggcttaggcttaggcgtagtacgaccgtcgtcgatcgggttttgtcgagagctcatgtcatgcagggggtatccctgtcttggtgggcgcacacatacatagaaatgcacaagctctcggtggtattgcattgacgccgttatggcttgcggatacatcccggggatattggctttcgcttgtgaaagtcatgtgcgggtggttagggggatctagactgaactgggcctggctttttccggagaattattggttccgaggggttggtttctacgatttacgatgacgatgacgatgacgatgacgatgacgatgtgcgatttgctatcatgtgctacgttactaccttctttacgtggatagggcgtgtcataccttgcagacaagactataggaacgggggaaaagggggccgtctactccgtgcaaagttctccgtactgtgttctccgttctccgtatataggagaataccgaaggaagagaactatgtcgatcgcttgtctcagagatagatagttccactctatgttgtgttccatatctgaaactattgtctatattattgtaagctagacattccaggaaacactcaaaaagaagaacgggaaaaagagtgaatccacattccatagtcggattgtgtcagattcgggctttgaatgtaaaacaaagagtggaataagctaactaacgagtctagtgttgaatatccgcttctagcctcttctattggccttctacgcggtttctgttttggttctctagcgtggaaatctcaagccccttttttttcccctgttttgctcggtatcgcgtattttttttccacgctcagccacattccactgtagcggatcgatcgctgtttcaggaactgtggggaatttggcacgttccatcaggggtggtctgctcttgagattttctcgctagtttggaattcctacgatctgttgatcgctgtgtgggagggatgatcggtgtggcgttgcttttcccgttgacagtttggtaaatggattatcgctctatatttccacatttggcatattgggtcacatccctgaacttgaggaagcaagtacctacctaggagagagtggaaatcctagattactttcctaattacgtagattaatactatattaacttgtctccctaatatcccgacataatggcaatatgttatgcagctgcaacaacatagccaatcctccattagaaaatagattagatttcgaaaagtctagaagggaaaagaaaacagggatcacatggaatccaactcagacacctgtgagcttgtctatatccaacaagccagagtggatatgcgttgttgcatgtcgcccgaacacgaacactcgatatccactgcgccctataagcgttcgaaggcacccgtttgaccctctgatccgatacatgtgtcaacccgtcaaacgttgccgtcgtggagatgtacccgatcggatctacacggtatacgcctctcggctaatagttaccaattggttgttagttccggtctggaaccttcggctttggatgataagcacggaacggctgggatgacccaacaagtgtttggccccctggaagagccgctttggggcgtagatcctttaatctcgggctctaaggtagtcgggcacgttacgtggacaccggcacttggcggaagaaatttgcgatggatagattgcttttgccgagagttacagccagtacggagtacggagcgtgctggggctcagtttaatattgacgttttatatattaggctttcttggtggatcattgttcgggtggaggttgcagcctatagaggctcaaaattcaattggcgccttcaatactgcattgtagatgtttctccagatgcaacggtctatacatctaacatctgccggcacacccattgtgcggtctttgtgtggagtgtccaatctctctcatcttccagagtttcggtatctgttgcgtcggtatcattcccacttgcgtggcaggcctttccaagtgcttcgaagacaacaacctggtctctcatgtaactatctagacaagctctcttggcggtggaagcaggttcccggtctggctgggcatttggactctcatctgagatttccccgatgaatccttccacgcatcggcggactagatgtgcagccgcagaaaatggtatctcattttgagaatcatgccgacggtcctgggcttgctggtgtttttgcttccctttgttctttggcttaggcagacgatcacttcctatgccgccgagaatatcgtggcctattctgaaccctgaggaggtatgagccacaagaaggatatacacatggctacggtgatttgtagcttccgatgtgtggattttgataggaactggtgtatctttggacgatgtctcgggagcatcctcttcagctggacgcgatgtagagcgtttggcaaatatagacggattcagcttcatcgcttcacgacggagagtgtgctgagtgaattgttcgataaactggcgaacggtactccccccgccctcttctgcattggcgttcaatgtaggttgatcaggtgctagcactgtgatatcaatttgcgtaactttcccacgtttgtgatccatcaagttaatccgcgggaagctgcatgcaggctcggctgccctgtctcgttgtactgactcctcgggctggtttttgccatctagattatatcgagatcccagcgtatgtatgaggaaagtgactgatccaaggtcaaccggccccgttgtccagccgcgcttatgaaggataatggacaggggaggaagtccaagcttggcaaaattgggcacgatgacttgtgctgcatagtcatatgaaggagaataagaagcgttggttccaccggttatggttactttcacaaagtgagcagtcacctgcgttccaacatgaagcagatacgggtagagggcctggaagacgagaaagatggcaccggcagtcgtgagcttgatgtcgtattgagacttcatggtggcatgcgacaagtccagaagcggtccgcttttcgatctggtggaatgcggaaagaagttcaggcactgggagccaacctcgcctcccgatactttgctaccgctaatctcggccaacagcttcactgctgcagcatgagatctcttgagtcccttctttccctctctgttcccgcgaacatggtcaatactaactggacgaccagtcaatgcagacagcccaatggcgatgcgaaccagctgcccacctccttccagcgttcgaccgttcaaatagacatggtttgatttgggtgaagtagatcgcgaggccgccatttcaggcaatttagttatatttgacactgataccttggaatgcctcgataaatgtgcgaaaaacaattaatatattcatttcgacttttgagttggtcctgagtcagatcatgaggctgcgtcatcttggcgtgagtcaccgtttggggctcttagcgcatagcgaagcttgcttctgctggaaaggaaaccgagatttgaccaagagacttggaaggttgggaaatggaaagaaatgtagacatggaagttgccatggggttatttcgcaccttccgtactgcccaggtggtgatgaagtacttctttccgtgacctcgtcttgaatcttctctctgcaaattcccaaatccgttctgctctatatcccttcttcagtcaatactgctgtacttatatactctgcagacattttgtaacatgttttcctctacatccaatacacgcagcctaagaaggtccatgtccacccgctcaatacgaaaaccgcgacgaccagccgcggagatccccgatgcggctgtgcagcatgcagccactgcagctgcagcttcccgggcaatgcgctcaagtcaaagctcgtctcaggagtcgaagaactcatacgaacgactaggaggtccaggaaatgtggccatccctcgaaggcgtaccggatcgagtcttcggagcactgacgatacctcgtcggttgtccaggccgacttgcccaaagtccaaaaccttcgtcactccaaagaattgtccggtgtatcaggtcgagcgccttgcttcgatgaccctgccgcccttccacccatcacggagctcgatggacttgatggacgagacagctcagttccctcgtcataccgccgactgcgcaaggccaagtcaatgttctcaaccaggcagcgaacttcacagaccccgtatggagtgcctccccttccttgcggtgatcctcttgatcctgagcgcagtcctggattccagctgccacgaacaatgagacgatccgtgtctttccttcgaggaagctatcaatccacacaggttgatccaactgctaagggccatgatgcagctgttcagcttgctcgtagtcaattcgctcagactcccgacggtagaggtgtacaacctcgccggtcatctttcttactcagacgcaagagggagcacaggccatttcgaaagtccttccgggccacaagtgaatatggcgtcgataccaggctttctcatgaattccgatccttttcaagttccatcaaaaacaaattcagacgtgtatttgggttttccaggctcgccgatcaacctacgccaagtggtaccccaaatggcgctgaggtgtccgtagaaactcccattgaaaaatgcacggaggaatactctccacacaaacttgcagtcactgaagacggcattgattctaactatttccagtcaatgccccagtctcccagccacgatagtctctgcacttccaagtcgcgcgtcaccagttgggctgattcaaccaccccgaacacagttactacccggaagccaggacatcgccagtctctttctttgatccgagaggacgggaacctgcatcagcaattaccacgaactcctactatggatgatacggcaaatcaatctcctttggacgtgagggcaaaccctcaccgaattagcatagtcgacagtcaggatctgtacactgcgttgatgaagcaaatgggccaaaattccctgtctggtcccgacgaggagatggtcttcggcagagtgtcccagcatcgtgtgattccagagcgggcgagttcggtctactcccaacatggccgacgcagtatccgccatgtcgcaagccaagaatgttcaacctcgcctggttcattcgcaacagcgcgtgatggtgatcaatccagtccacgaaagtatccgcgctcggctaagtcgatgcaattttctcggggcgtgccgtctcgggtgaagaatcaacatatgactgctatttcagacaaaacatcgccgcaatcaacgtacgctttgagcgaggaatcggatgaggaagatggtagcgttattgtttctcgcactcgggcctcgaaaagggacattgtttccccaagtgtctattcccgaaccaccagtggcaataccccaacaagaactgacaatgtcgacatggacatccatgatgaaccaggaacagcgaccatcttcgctccacagcggacaacatacagctcacccaagcgtgccaatcgtgtttcatcttctatgcctcatagaaaccccagtgcagactggcagcaatggatgagctcacagatcgaaagaattgagcaggcaagccccacaagggaacacgtcagagaagatgcgcagtaccaagacgatgatgagtactttactggcctagctcgacgagctcctgtcgctgtctcggctcgctcttcagcagttgtaaaggttcaagacagccaaagtatcactgagcgcaaagcctccactgagaacaaagtccggtcacagagcaatttctcccgaccgttaatccaggcttccggcatgcgaaccatcgtgccattgcagacaactaagtcagaaaatatggcgcaggctcacgctacctcattgtccatggataccgctaccatgtctggcgaaaatgtttcacccaagccaattcccgctgcttgcaatcaagaaccgtcgccaatacgattgagatccggaaatatgcagccgccagagtccccaaccccaaagggagtgggcctgaagcgatcctggaccaaagagcaacagcgacgctattcagccagacgtgctccaatcgctcaagatagtaggatcaatcatttccggtccatgcgcacccaacgagataaccgtgcaaacaatgagaatgcgaggcagcgggatgagtacagtgacatgatggagagctaccaccaacttcaggacatacattccacgatctctagcaagcgcatggtggatatgttcttggacagtcgccgtcggcaaatgggtgaaatcactgacaacaatacaaccacagaggcttttctttgaatgtgagagacatacactttttgctattggaatacctcggggggtggttcattttttgctctgtcatattctttcggagatcctgaccactcattcactcattcactcatccatcagttttgggacatgtatactaaagctccaggtcggagttgggcagtttgtttacctgatatcgaagcatggaagcagccatttttatctttcattatttccaccaaaaaaaaattagtcgaaacatcattcatttaatatccagccagttcgatgaaataggaaaaagaaacaagagcaaaaaagaaatctctccctcggggaatcgaaccccggtctcccgcgcttatcggtgttaatgacaagcggaaatcatcaccactagaccaaggaagatgtgatggctgagttactgctcggccacttggctggttgatggaaagacttgaccatttagatattatgagggagccctcataactattcacatcggagtcaacaacgtagcttcaatacccatttatccagataatggttgacggcaatatcattcctggtcgaacatgctatagattaattttgttctattcacgagcagggggaaaaaaaaaaaaaagcaccccgaggaaaagaaaatagttgaagctatcgaggatatatatattcttcgattgtcccatagcctgacatgtcaaccacgaattgtatcgaagaacctgtattcaattgcgggggccatgagattgcacaaaaaactcaccgcatccaagagacaaaaggtgtttaattgatcagatatcttcgcatatgcctctcgaaactattatatatggccgtgtatgtatgtgcttccaaccagtgatatacacgcgtggtactaagtgggtcactgcgtgtaaatacgtgttccatgtagggaattcccgtgtgggtatttgccgtgttggtattccccgaataagccgcagccaaccctccatggatgtaggtattttccatgtaggtattttccatgtaggtatatcccttgtaggtattgtccatacataagagaagagcaatggttccgtctttgcgtagagtgacttatccaagggacataacacatttatccaatggatatcttcctcgacattctggatacattggtcctcgatcggtgctacgcattcctctcaccagacccagcggcaattcccaacggagatcttccaaccagtgccaatttaaatcgacatgttggcatttattaccccatgcagccctcaaagtgggcagaggcaagcctctggaagagagatgacattgccagacaagcattgtcgttatacttgatcacatggtaagctctttcaccaaaaatgcagtatcccaacgactgattcagttctccatacacgaaacaggcttttcgcaatgataatgtacctcctcggtagcctgctactataccacacagtgtacgacaaaagactcctccaacacccacgattcctcccaaaccagatcaagctcgagatcaaccaaggcatctcggcaatccccgtaatggccctcctcaccgttccatttttcctagcagagatccgcggatggtcaaaactatacgatttcaccagcgactctccgttcttcggatacaccttgctgcaatacccgttgtttatctgcttcacagatagcgggatttactggatacaccgtggtctgcaccatcctcgcgtttaccgctggcttcacaagccacaccataaatgggctgtgccgacgcctttcgctagttatgcgtttcaccctttggatgggtggtcgcagagtctgccctaccacgtttacccgttggtatttccgttgcagaaaggtgcttatctagggctgtttatctttgtcactgtatggacggtgctgattcgtgagtctgtccatccccgtgaaacgatagaatggttgcttacgctgtttccacagatgacgcagagtatatgccgacatcggtggtgattaacggtgcttcttgtcatacgatgcatcacttgtacttcaactacaattatggtcagtttacaacggcatgggatcgcctggcaggaacgtatcgaaaacccaagggcgatggctttatggaaagccggcaattggatgggaaggagaagattggagataaactcgattgagatggattatcgaagagggcgggttttgtattcgaatgtaccagtataatcgatcgccaatttggcctgttattgacggggtcttcatttgactcgagaggatagtaatatttgttaagacaatgtagggttggatgtctatttcgatttcaattgtcctggccaaaaggaggaaaataaatagccgcgaattgcagcatactcagggtgaaatacagattttccatgtatgaacccggctatattatgttatatccaacctcatgacggagcttggtggcaccattgaatgaattcattcaaattccccaagtcatcggtagcagtgttatccatataccgaaggctaacatcagatctgccggtagcatccagcgtggcattcaacaaccaccaaagctcctgagcgtgtttcggatatccaaggtgaaggaattgatctttatccaggagaccaatgacagaatcccagatgagcttccagttaccagatgcacagcgtattctatcgagagataggtatctcaacaagcccgctctcgcctggaatgcgagggagttaatggctgttgtgacattgttagcaaatcaatcatttggctggttttggtcgcataccgtaaatcagaatcaggagatgctcaactgataccgaaagaccccatggtatccggtcattacttagaggggtttcgagcaactgcgtgaccacgtctttcaggggaggaagcgggagctccgtcgagtgcgacatggcaatcctgctgaaagaggatgcgttttcggcttcccataacccggcactccaaggaaaatgacagtccatttcgaagaccgatattgacgggtggtttttgaagcagactgtgaggaatccatccgctagaaagacccaacaagcgattcttagagctggttagcggtgcacctcgaaagatcggagagaatggggatatagtaccgtatacacgtttcctccgccactaaatttctccaagtcctctcatcacaaacggtgggagcggttcctcgcttgagctgaaaaatcccgagggatcgtatggtggataccaaacatggatgtcggacaatgcgaatgcgacgtcttgtttgcatattgtcctgtccaaattgaagcatctcaataataagagcactttgtagtagctgtacagttgataacaaatgcgactggtctttcgaagcgactgttgatagatctgcaattttccggaatatatactcttctgcgacgtcgaagagaccggatggtagggcacctccatccaatggaatagtatatgtggcaccggataagaatattgagagtaacaaaggattggagatgtttccggggtcgaaggttggaaaatgcaccacgggcaaatgccagtgaagagagtggaaaaacgcagagatagaagcggagatattggagacccccaacagagtagaaagctccatagtatcaagtgggtttagcgttcctgcagtccccagacccattgactttgaagtgtcgaccaactctgtcatgatctcggataattggttggaaagttttgaaggaaagagtgtatcaggactgaactgaagaagataatcgtccgtgaaagagggtagagttgacggtatttggaaaggcgaacttgtaagttggaaatcgccaccaaaagccgacataggataagtgggaacgagagcatcttcgatatgggaattgagtgtttcgaggtttcttcgaacagagcattttgccgtttccccaattgccagcctgtccctctgaaaagaaggatcagcaaagtgttggagaaaagaaaataagccactgtctcttgaggtggctcgcgatacggttatagacggcgagagcgaagttactgtagagcaactgggatccccggaaggcacctcttgggttacgaaagtacattgtcgcccaagggagagacaacgagagcacggtgaatttcggtcgcatgatactttggcaaagaagcatggctcgcaggaatgccttttcctgcccggcttggctgcaggaggcgcaggttggttgaacttttttgcgcaagtcttgatatgtcttcgtgcgacctcactttcgaaatattagatcatgttcattatttatggtgaagatagtttacatacgactttacaaatgctttgccgcacaaagggcagctggaagagggcagctgtgtatctgggaggtggtcagcccaactccgtattcacatttgtaatcggggatcattggaccttacgggtcgcttcatgacgaattaaatgcgtcttcctctgataggccttttcacaaagtgtacattgaaacatgacttcgaaagccgcctttattgcaaagctgaaggaaaaaccaggaaaggggcggccacgaaggtcgcgtggacgaatcccatccgtgcgtggccgaatccttcacaaattccaaggttggcaaatattgatttctgaagtcgcaaaaattggatttcaacttggacaggctattttattattgtcttaggtgaggttcttggatggagactgaacggaatggtgacctatatcaaaatttgtcatttattcgggcaatgtgcgcccgacctcgggagtccttcggagtacggagtcggagttacagcccaaaggcttcaataaactactgaggacaaatgggacagggcttgaccatgccatgctatgtagagtctgcaagggtaagtgatagaccacgctaataacgctgcatactatgatttgctagtgagacgcttcttttggcgggccactagaggaagattgctgatcttatgtttgtgatcaacaattcaacgtgggatcatctctatattgtagttcctatgttttatatctatggtatatgcaaggatatctagaaaaaccacggatatcaatgaaggctggacacccggaggagaattacctcaagcgacagctctcggttcctagtcactttcccaaccatgaagtaagccggttctttttaaaatctatttactatttacgccatgggagcaattttacggaagtttccgaacccctgccgtgcacgggacctgcatcgaacagatcagatcattagtggagcagtacaaaaggtttcctatgctgtagattaaggtatcatatccactggtggagagaagtcccattttctcgagcacacggtgttcttcaatttacaaatccatggagatacccatgatctttgtgtatgaaaaagtccgcaacggatgtattcaggcgccggggtaaagccggggatcaaagacaacgatgcccagactatagatcaggctccacatacggaaacagacgttgtgggtcagaacaagattaaaaaagacccaaaaagatccaaatggcggtggggctcacatctctagcgcagccaaggtcaaggactctaaggattagaaccatggggtagtgccgaattagaccgtaagtctcaattcctgtgcaatacttcggcgtccgatgcgatgtacaacatagtgcttggttcgtaaggagtacataatagtttgcgctggactggaaagaaaaagcgagcaggtttgattggctgcagatttatttagaaatgcagcgtacctgactaggaatccttgcgctccagtagccgggttctgcaccagctaggaggcacctgatgactggtccgttgggattacgggactccaacttagtggaacagtcattttgctggtctaatttgggattattcggcttgtctcatcgaatagccctatattgaaacttacaccttgcttggggtagcccctgaactgagatatcacgagcacaaagaactcatcgagatacgttgtgcatatggggatatgtgtggctgaactagtttgggctagactgccagcgggagcaatcaaataacgcgctaattgcattagcggcccgggaaggaagtgataggtccagcataagattgggatatcaggtttggttcattcaccaacttgtcaacgaaaaacgaggaaatcacgagtaggcaaccaatcggaacattagttccaagtaaaatgggctggtctagtctgaacttctcgcttggcgttcctttttgggctagataatagcttgcgatgtacagagtacgaagcgtcgaggtttgctcccctattttaaaattgctataatgactgcctggtgggttggcacatataaggctggttacctctctggtttattcctgctcttcatatcttcgttgtcagctttttgacctatcactcgttttgcaggtcattcagcgtccattctttacttcgggctgaatagacttccaacttgcaacgatgaagcaatccatgatcgcttcgcttgtggctctcgcagcctcgtcctcggtaagaaaattccacggagggttgctgttgtatatagatctacagctaacacatcaccccatggtatagggagttcaagcggctgatggcttgattaacgtacccgttaatctctgcgcagccatacttggagtggccgaatgcaaccagaagaccgtgacaaatggattgatcgacatgcctgttaatgcatgtgctgcagtccttggaaaggcccagtgtgaacaggccgctttgtcttccaggagcgagggtctgattagcgtgcccgtgaatctctgcgcagccatccttggagtggccgaatgcaaccagaagaccgtgacaaatggattgatcgacatgcctgttaatgcatgtgctgcagtccttggaaaggcccagtgtgaacaggccgctttgtcttccaggagcgagggtggtctggttagcgtgcccgtgaacctctgcacagccatcctcggagaggccgaatgcaagcagaagacagccagcagtgatggcttgatcgacgtgcctgttaacgcatgtgctgcagttcttggaaaagccaaatgccaccagatctcttctcccagcagcagcggcggcggcggcgacgaccatgacgacggtgctctgatcaatatccctgttggactctgcggagccatccttggagaggtagaatgcaagcaaaagactgccactgatggtggcttgatcaatgtacccgttaacacatgcgtggctgccctcggaaaagccaagtgtgaccaggcctcttcctgtgacagcggcgacggttcccttatcaatgtgccgatcgacgtttgcctggctgtccttggtgaggcccagtgcaagcagaagtctgactcaaatggtggtctggtcaacatccccatcaacgtatgtctagccgttttgggtgaggttgattgccatgatagatctcccccgactgagattccaggcaagccaggcaagcctgatactcccgtccccgttgtccctggcgaagtcccaggaaagccaggcaagcctgacaccccggtccccgttgttcctggcgaggtcccaggcgaggtcccaggcgaggtcccagggaagccaggcaagcctgacaccccggtccccgttgttcccggcgaagtcccaggaaagccaggcaagcctgatacccctgtccccgttgttcccggcgaagttcccggcaagccaggcaagcctgacactcccgtccccgttgttcctggtgaggttccgggcaagcctgctggccctggtgagactcccgtccccatcgttcccggcgaagttcccggcaagcctgctggccctggagagactcccgttcccggcgaagttccaggcaagcctactggccccggagttgtccctggagagactcccggcaagcctgctggccctggagagactcccgttcccggcaaagttccaggcaagcctaacggcccaggtgttgtcccttccggcactgtagcacgcccatcccccaccggagcttacacccgtgtgactcccacctacactagtgtcgtcactgtctgcaacgccgcctgcaacgcctccaagacctctactggccttgtggttcacacttctcctgcatctggtggtagcgggagcaagcccagccccagtcacacccctagccccagccccagcatcattccgttcaacgaggctggccgtgctaccttgtccggtgttgccgtggtgttcggagctctctgcgctgttgctatgcagatctaagtcttgatttaagctcagatactggcgaaggcgctagctggtggtgacttttccgatcgttcaatgttgagattcacagttcttgttgcgttgggcataccagtctgtctgtcttttctttttctccttctctgttccattgtttaaatcagcataagttaatataatcccacgatatacgtctatgaattcacctagttgttcttgctattaaagctttccatgtgtatatggtgactttattggttacatcactttgtatatgccaagggaggtgtttgtagagtttagcagttccacgggtgctgcccatcaatccgacgttagcttccagcttaatcgaacattggagacttttacaaacacctttttttctaaggaaaagaaaaagcgaattccaaattcattcgttctgccaaaataaaaggacaaaagggtcgaatgtgaatgaaaatggcaaaaaaatggcaaaaaaaatggcaaaaaatcctctgacccgggatcgaaccagggacctcaagataacaagttccatgagaacacgtcaattacagtcttgcgctcttccagctgagctatcagaggatgttattgacagtcctgcatcttataacaataaagtcaagctcaacgcaaccgccgcattatccttggctagcattttcctcttcttcaaaatcactcctgaaatatgtatattgactttggataggtaaggaataacagatgcgtctttctggatgcctatgaagctcgacaagcagctctgacctctaaataggggcatgtttcccagcatgtcatcttcgttgtgagggcgatggacagtctacttgcgaagctgaattatctgtgtgtgagagtacgacatcaagccctggttcccccactcgcctccaatcccactttgcttccatccagaaaggtagccatatgggttggggtcttcagcgctattgatccatacgcttccgacttcgactctccgcgcaatgcgctccgccttgccaacatcatccgcccagacgcagccccccaagccagtttctgtcgcattgacccttgaaatcacttcatcctcattagaccacttcatgagcgggatgacaggaccgaactgctccaattggacgatgcgagaatcatgtggtggttgatccacaacgacgggtgcgatgaaaaaccctgggtgctcgtcggtagtccccccacaaagtaaagtatagttgtttttcttgcaatcggcgatgatatctttaaccagtctgtactgtgactcattctgaatgggactgaacataggtgactggtcgccagcaaggtcgattttgatgtccttgactgcctcaacaaaagtgtcccggaattcttggaaaatggactcatgcacatagactctttttgtagcaacgcacatctggcccgaatggataagaactccggcagcaaccttagcagcaacggctttgacatcaacgtcggggcagatgatacatccatcatttccaccaagctcgagtgtaactcgctttagagtcttggctgcgctttctgctacctttcttccagtcgcaatggatccggtgaaacttatcttgtcgatccccggatgaagtgtaatgagccttcccatatcgtcgtctccattaagcacctgaagcacaccccgcggaagcactgatgttgcaagctcaacgaacttcaaagtggcacatggggtggatggcgatggtttgacaatgacgcagttacccatgacaagcgctgcagaaactttggcggcggctaacacgagcggaaaattccaagggcaaatcgcacccaccactcctataggatgatgggttgacacgatcttggttttatcgttttcgtgttcgactttgtcgggcaatgactgggatgctggaccagtcagcttttgcagccaaacaacgttcttgaatgtaaatttgcgataccattaaatctgataaaagccaaagtatcattaatctccatgtttgcgaggaggttctgggaagcttattagcaatatttccaatattcacaacatggaaggtccttcgttaccgattttccggtctcccctgccaaaggggcatgtatctcatctcttcgctgttctagctcatccgctagcttcagtaggtacgtttgtctttcctcgatagtcaagagcttccatgatttaaatgacgcccttgcagcatcaactgcgtagttcagttgcgtctcatgtgcgactggcacatcccagagaggttcatcggtcctggggtttgtgactgttgtagaatctccggagcggagctccgagtcgatgatattgtagaacatttcggatcttaggaaaaagagcaagactcgacatgggaacctaatacatctgccaactgattaaatattgaatgccagatgagcagtgggttgacgccacatctgtgacgggattcctacctcattttcatcccggataggataccagatggcgcgggccgagtttgagacttcggatgtaaatgaaattaggagctataattagctgaggagctgacgtcgacattacgagggataccaagagggaaatatgcctgaggcgtgggggattgcaagcgtggaaggaatttctagagaagagccacgaatctcaaaacaaacaccatatgctgagctgagctgtgttttggaattaagtcagagttagccgttgcatgcccagcatcctgattatgcattaattacattggataccttgaaagtctacctagaaagtctagctaaaaggacacgtaaggagtctgcggccgcataaccaggcaagtattcttgttgtaggaattggctatagtaggaactagtactatagaagctaatactgcaaggactaataactagaactttgtaagaatgaggtgatgagtgtgtggaaggcggccaaatctaaaaaccatagaaaagtacgatacggtgcactgggggttggagactgcctatctccctccctttgctatgctaactaacgtgtcatgtctccaatacatttgcgcttcttccttcaaatcaaggtaacgtgtattatagctctaactacatgtaggtaaagtaccttcttgtttgaacaattgatattggcatgtcgctaagcaatttaacggaacaagcaatccttttattatgttacaaaagatccaaattcatcggtcaaagctcatcatgtggatgatcgtaatcatctgcccatatttcaggattctgtatgaacttccgagcacgatgcgcgcttccgattgcggcgacatacgccgggtccagctggtctcgaagcataggaatccattccatgggcagggcctgagaaacgatcgaccggagagaattcatcgcaggcaacggtgcttcgccacttacgatgaccgctcgaacgtgctgcgcgtcatccgttttcttcagattagagatgaaattgtgaatgacctgcgatacccggctctgatagtcatatagattagagtttatagatgaatcgtgaacaagagagaataacaaacctctgaatccgccgggtctaccctccatagtcctaagtctgggtagcgtgcgtagctatgctcatgttcaagtgtgtcgactccgagttctgtgagatccgcggtccacaaatccagggaatagccgttgtaatcaatgtaaacagcgatatttaatgggccgtgcatcaaatcaaagtcaggaggatacccaagactttcgggtgtatcaagactataggccaagcgagcagcattgaggaaccctagcagctgccctgggtgcgtcaattccggagccacatccgtgcctgttagcgctgtcaagacgtgatctctggagatggtgtccaaatccgagggtaggctgacggctgaaatcctaacagggcggcctagtgtatgattcgcagccccggtcatgtgccgcagagtatcagagagaatcatgctatcattcttgctgtagccttgatactccttcggtgctgggatgagtccatctccttcccgtaggaagaccttttgaaagcgcactctgggaaaataggagatatgttagctttggattccacttcacttggtcttccgggtgcattaaattacactcttttttgagagtcagtgactagactctccatgtgcttttgatagtccgctggtgcctcaagtttcgccaccgtgatcgattcattagatgccgtgtagtaagccgccgtgctagtttgagattgcctgtttagtaaccaaggtctccggccctggggatagaatcagagccacatacatgtacttaaatccgaagttaacaccaagggctgtaggcagacaaggattccttatgttagcgtcaagtacaattttataaacagagtcatccatacgatagtcgtccatagcaagagccagcgtgacccagagcagaagccagcgtagcgtccacatcatactcatggccaattatacgtgaagaagttagctgatcagtcgaaactacctaagtagactcgaggcttctttttaaaaggtactccctctacggagtaggctttaggtaaatggcgtgattcccaataaagtactgcaccagaacgcaggtcccaccgaaattcactgggagttacctaatcgggactgatctccagagctgtttcggcccccacccgcacatcatggaaggaaacacgtttgaagagacggagaacgccggttatttgtcccgtcaattccgttgtgggtcgcttgtcaggaggctccaagactgtgcgtgggggctaattacggttccaggtaaggttgtggatgatctgcggagcctcatcctatgtacatgtggacatatatcatagagaccttccattataggtagccttgtgtaggtcataatcttcgttcaaggaaagatcaatcttggggactctttccaaaattacaaatactcccccctgatggatcaaccctcccctcacgcgaaggaagtgaagatcccaatgaagaagcgtgctagccttatggcttgatctccacatcccgactacaaattcctacataaatatgctgtcaagggtacctctttcatttctggcagcctctcgagactgaagctggttcgtgtgcgaaatggcttttcaattgctacttgttagcatctgtctctcctttctggtgaatccatcaatctccacccctgtgtcgactgacgggactacgtctcttttcgagagagaatgggtccacccgggctacttggacatgttgcatagtaaatggaggggcatctactttaccgatgctgcggagacatgctcaagcgagcaactcgatacattagtcaagactcttgaacaatcccataagcttctcttgggacccccgtcatcccctaaccctgcgaaaacccctggctggaaccggttcttcctcaatgatgataatgtggcagacgatgaaggctggtcggtaagtttgcctggaatcctctaacactagcatgaaactaactggagcgacctatgtagggcgaagctcaacaggatgacttcatgaacgtcatgcgtaagaatatctatcttcgcctgcaacatatttggctaacaagatcagacaatttccagcaggcccagcatttccctgaatggggtactaactataaatggaaaaccatgaagcctggaagtcggatcacgtttacatgcaaagaaccgaagatagccgcaaatcgctgtaaagacaagggctcgtaagtccgataactattgacaagaagagcaagtcattaatgagtttaggggtgcattccgcttcccaggaagtcacgccgattctgatggctacggcgatgttatcgtgttttgtcccgcagtcttcggaccgaagtacaaggacatggatgaactgattaacggccgccggaagtccatttcgtacctaccccagctatggacaaaggcccatgctatgacacacgagatcttccattgccagcgagcgcttaaaacccagttcttgagtaagcccggaatacggcgtgtcacgtcgactcgaatgctaatgaacgtactcagttacggacatctatgataacgtcgctggcattacgtccaaaaaggtatgattctttcttgcttttctttttttacaaaaaacttacgatatcaccaggccgtctatgggccagagtactgcgccagatacgcacggaaaaacgcggtacattcccgcagaagtcggaacagaattaatacgaacgtgaagaagaatggtgattataaaaattccatatttatctaaacacgaaacagacggagctgacattaatcacagctgatagttacgcatggctcctgagcttcaattggcttaattattacttcgactggcaaagtaacggcgattacgaggtggacatcatccacgacgaagtcaagcgcgacacgcagactgattccactgataacgacgctgatattgacgttgaacacgatcccgatagcatgctggatggcgactcgattgatgtcaatgaagtttatcctcaggcaaactgtgcgcaagtcgggagcgatcccatgaacgtgaagtgcgagtatgtggatgaggactatgacgactgggtcgaagatcatccgcatccatcagtatcacgatccatggtatcggccacggcgacccctacctcaacaccattggtttcagccacacctacacctaccccttctgcgaccgggtcggccacatgtgaagtgatctttgaggatgaactgtcttccacaaaggattggatgtacaaggttattgtgagtggagattgggccacacaggacgcgatcaaatctggtgtggaaggctgcgtgagcaactccgacgaccttaccgcctggatttgggaggatcagggagatgggacgtggatggctgcattcgaccttaagaacttcgaggacgaaaattgtgtgccggatgccatccaaagcgcatcggatgatctgatcaaggatgtttcgtgtccagtccacaatggcgcggaccctactctctcaactcggttgatgatggagggtgcttctggataatccacgagcttcctgcttatactgggttttttttggggactatgtgaagggtcgaagatgatgggcgtggctggagataggatggatgatgggtgagaagaggattccatggaaggccagctaatctatggggtgacggttggcagctggcatccatcgtccttgacaggtttcaaaatgagagaccccttccaatgtacttcctacaatcaaaaataacccagtttgcccacgtgtcggacattcactgagtttcatagatgctgacttcgtagatcgggtattgaggcagttgataatcagggtgatgatgaactcattcttgaacccggagtttttgaagaactgcgtcccgtagtagatgatgaaattgatccgggttagctgctacagcccttgcaggaaacatactggagcgagccatttcagcagatcgccccggaagcagtcgatgtatcccgactcgccaaggctagcctcataccggtggtttgcctggatctcggcgagctcccggaacggcttcgtgatcttcggggaggcgacggagtcgcgagaggctgcgcgctgcggcttcgttgttgtctcgcttcactaggtagcgtggggttttagggagaatgagcatgcctaccactagaatgatagaccagaaaaaccggagggcgatggggatacggtaggaactggagtcgtggtgatcgtgcgttgcgttgtccattactgatgctaggtgacgatggtgatagtgaattggtacgtgccgacgataaagtctcggatccatttaggtgcggtctcggactggtagagagggacttttgggtgatatcgtaactgtcagtgcttggataggtgaagaaaggaaattgcatggcaagtaacatacccagagcagaaatcaggcccaccctcaagcagacaaagaacccttcgtcaagaaagggcggaatgtcggttgcgattgtctgcaggattactcccagagcaaacacagcatttgacgcagccagactggccgggattgtccctgtagcccgcggagaacgcggcagcccaaggaggcatgggaggatgccactgatggtgccagtatcatagctagataaacacgcgcctggtcagagagcgcttccacgagatggagatgtctaccccccgcgccagctatggcacccacccaaacagaatccccccgaaggtgacgataccacttataaatatggcaggccaggctttgctgcagtttcttcgggcttttccaacagaacgcccatggtatttatgtaacggcacactcgaaaggggaggaacaggagagtattatttgagaaaaactgatatggaagaggatttgagctatttaaatgtgtctaggtctctcggttatagatatcattatatttggacaatgattgtcgcagaagcaaatcagcttcaacgccttggaatcgtgcaggatccaaggcgtccagcagagccttatcttctgaagttgtcgcattctcaccatcatcaagaatctctcttgccaatagcttagcagtaccagcagcagttgtaacccaaatggctgcagcaagccatagattcgcaacatcaggaacccgacccgcgaaaggcaggttgtcaggcgtgacagaaaatataccattgaatggcttgtctgctacccaaggctcttctgtctccatgttctgtccctggacctggaattctgttttgttcttcgggttcgaacaggcttctgacagcacttgatcgaagcttgatggccaagctccaatcgcgctttcagtgggatcaagctgcatcgggggatgatcataactgcccaggccatctcggtcaccgtggtcccttgcatagacgtgatggtccagccagcgaacgaatggataaggggcaccgacacgtctagttcgagccggagtaaaggtgtaagggtgtgcgacggggacgatgggaatggggagttgcgtaacaggggtgctgccattggaaatcaaggaagatgtccaaatgccagtagcgagaatcacagtactgccttccgagttgatatctccgctagcggtcttgatagccgctatcttcgacgtttcgttctctatcgtggtcgcaaagcctgttacggcggcttccaagaaatctacccctctggtgcgagcttggtcgacatagtaggaagtaatgacgcccgcatttgcggttccatcggatgggaaatgcagacagtgcttaatcgagttggcgtcaataaaatccggggcaagagaggcggccgcttctggggtgagaagctccgcaggtagaccagcctcctgcgcgattctttgccggcgcgttaatgtctccaagcccggaggcgtagaggaaagttccaagctgccgactgtttcaaagccacccggaattgtgaggtagtcctggactgtgtctttagccaaccgagtcaagaccggcgactcattgagttggccaacgaatcctggagcgtgaccggtggaacccaatagagtttctagacttttgtcgatgagtataatatgattttcagtttgggctttggaaagatggaacgcgagcgctgcgccgacaatgcctcccccaacgataatgatctggcgaggagagggattgctattcaattgcgcgatagtcaatgtagacggcatcgtggaactgtgtttaaaattttttaactgatttagaaagggtgagtacaatgaaagaggccctggatagtgatcttaactgtatagatggcgctatgctagcccgatgtcggcatccttgtcccctcatatatccgcccccaaccgcgcttttgcggagttgctattgctttaatcgttagtgattggttaaaaagtgagccaagtatgtttaattgtgacttggatccgctcaagtctcctcggcgttgaacgatgactcagttgtcatggacagaccacgttgtctcagatcgtaagacatgttgaggcttcgagcactatcaatggcagattatggagagtgtgtaaatgcgttaagctaaatgttcctggagcatcctaaaaaactcttctttagcgtactccgtacctaatttatgaatgtgaagacgttcgttaacatttggtattctgacagacggcaagcggggctccagaaacggctcctattgccctcctaccatcgcctttcaatatcccattccctatgctgagaaagtcctcgcagtcttaagctgttttccctggtacgttgcatgcactgtgagtttggactggttattcctccgaacctccaggggtccctactcggtcatcttcgcccgagatagactgttgcttgacctcaaccagaggaagagactttttggattcttggttttctccgatcacttgtccaccccctctcccgttgatgctgtctggaatgtaagatcgagaaatgactcgtctgccctgttttaactcttacaccagctgtgaagttggcacccagtctccgctctccggttaggaagggcccaaccacttgcaccgtcactggcacaacttcctgcatgaggtatagggccatgcactgtacaaaagcaatgtggctggcaggattaagcttcaagcgtcctcgtcaaagtcatcgaatgggagatggccagggactctggcaaactgcaggaagttaaacagtttttcttcgtcaaacgcacttttttctcttttcgcggccctatcgacattcaaactcaacatatatcagagtactatgggggcattttgcttacttgtggcgcactttagctatactgctttacctctcgtcattcccaatggatggatactcggctaccgtcacaagagaagcctatgagctatcatgagttccctatcccacgccggactccaactgcaactattcaagatctgcggtcctcctaaaaaaaggacaacttcttcagcatgctatttttcgagacacggatgtcaataaagtcatatcaatgctcattgataagagtgcacctttaaacgccgcgatgcaccaggacgggcgtgctttgatgcgattctggcctatgagcctggggactcctttgcatattgtaacagtccccgggagaacggatgcaattcgtcatttggtcaacctcggcgcaaacactagcgtcaaggacgcgaacggccgcaccgccgtggagtggccacaacggttgaatcaaacggaagttgtgagacttttggggagccaattgtgaagaaatatctcgcaaaatgagtagagggtaggtcgcaatctagtccatcactttgaaatgttctagatgtcccttccccgattctgtccgatgggtgtcgtcagacgttaaacccagatgaaatattgctatgcctttacttcccaacctccataccttagcgttatattatttacacccagataatgtaggttcccttgtcgcaaattattgtgagactgcgtgtcgcatccagaattttcggatcttgctcggaccagactactgcgaaacacgagctcgtattctggagatcttcggcccgatcgggctagcatcgtgaaatctctcccaaactgtacgaggaccggaccatccatgtcgcaccgcaaggcccatgtagaaaggttgcagctgaataacttggaaagcacgccgatccttgtactggttccttaagtgctaggtccgacacggatctaagcgagatgatcaggagaatcgagtgggagtttctatatttaaatcttcacctcgtattatcatgcagtagctcgaaaaagacccagatatatcaccatcgagcgagccgaggttgtagagtaagatgactacttaaggcatgaattggcctgtctacacgagcccacacactacatttttctaataagccccccatctctggtatctcgccgacaatgcgagcaattaaattcctcctcacagccctaacagccgccgccgttgcggtggcccaaatccccgactccaagcgcttcgacctaacaacaccctcccacgacctctggcggcacaagaaaaccgccgcctacaccgtgcagcaatcaatgaccttcgacaacgtcaaccgccggctcttcatcgtgaaccgccgaaacggcgccagcaccacttcgggcgacctcaccatcagcgaggtcgacttttcaggaaacctgctcggatccatggacttgcttgcctgcggacacggggtgaacattgccgccgagcccgtcggcagcgaaacatacatctggtctgagaccgacgccgcagccagcgggtacgggactgcgctgtggcggttcaagttcgaggacgggaagacgctggaccccgcgaaggatgacagggagcgtatcaagccgctggggaagttcgagcggggcacggcgacgattgaccctgtatatgaacggttcgttgtgcggtatcagtacgacaaatctatgtatattgctgtatgggatcttgatgatgctgtttcgggtaatttctcgaagccgcttgttgattggaaaataccgaatgtcaaggatgacttgggtgcgttgacgggtgtgaatcagggctatgcggtgtatggccggtatctttatttacttaccggggagtcctatgaggccagtggcgggaagcttaactcgcaggtgttgtcgatggatttgaatacgggagagctggttcaggggccagttatgacgaaggctgggtcgacacttgagttccgggagccagagggcctggctatctataagactaaggatggtgaggcgcgcctgttcttgggctttgcgtctggggttgcgggtgaccgccgcagcaatttgttctataagaacgtgttggtttagactcgagccttgtctgatattattatctatcccagcactcgacacataccagtgaaagggcaaagatctttgtttaatgggaggatactcgattctctgtcttccgagcgcatatagcggagagtttcaaatatatcaggacttctatcgcaacctacccctatagcctataggcgacataatctgttaggtatcagaaggggataaaggatgcgaggtagaaacgcccgtgctatcgaatcttttctagtcttcctcttatacttaggggaagtcaagccaagagacaatgcacttaggaaaaggtcgattgactaggtttgtcggtatcccctaggtcgtcagggtcgtatctgtctgtctcaagtctgatcgctcgatgtaaagagcggtgatggcgatagaaggcggaataactagtgtcaggctacacttatacctaggtagctctgtctctccctagctccgctctacctcttctcgcgtcagtctctctttcttaaactgacgccgtagctcgacgattatttattccatctcttgtcggatataatatcggcagataattgaatgacgccaattgaaattaatatagtgggggacccaccgtctagcacgaggaatgaaatttcacgagtgagtgtgcggtaatatgcacccacacctgcgaattcccacagttctatttgatttttacatatttttacatatattttatttttggctttggtctcgctcacgttcacttgtttcttattactatttgtggtaattacccctccaggaaggtagctttaagggttagtagtcggatataattatattcagtcgtgtagaatagttttggcaatcgagttaatgccttacgccttgttatgcactttctatgtgtcttttttgaagttgctttaagcctcatcagttaccatttaacatcaaaagtgcagacgagtcggtcctattgaacttccgatagagaagaacgggttttgtactaaatatctctagaattccgtagtatacaacaaatactagaacaacaagccaatcaatgtgcccgttccatgtacaacataaatgtaccttactgccaagtcctaactgtcgttctaacccagtgcaggtggcccgaggcgcaagtcttcgctccgcgtccagattcgggattgccccgatatgaatcccgagagacgttgtgcttagttagttggacaatagaatatacagatgacaaagttggagccactacaatatattccggttgcttgagcacgtaaactatagcaggccttgtactaaaagtcagacaaccagatcgcatgatatgaacatactcttgggcgccgcgggaaaccgcgggaacttcaaattgctttcataatgattataaaccaactgacccctcttccgaaagagttctgctatccgaggacgaagcacggccgcgagatactgagccggtggacacacctaaatcccgaaaacgcgggataggttgtagccaccgagtccaagccaccaacttcagtcaatatatcggtagaactaacgttcaggtcctcagaacatcattcgtcgctttgcgggcatgccaagagctagttccagagtgtccctaggtaggcagtctacagtgacgtcgccgggaggcactaacccgaccaacaaactctatcgagcacccgaagtatcgccggcgattggaacacatatagaggggaagatgccggcattctgtctccgatgaagccgtggagtaggataccccgctagccaagtctagttgccaaggcggtgatcgtgaaaatgtctcgtgcttaaagttgccatcctcggaccatgcggagagcaaatccagaagaaattaaccatcggtgagagttaacggagtagtagatagagagactagtctagagagttcagaaacgtcataagttgtattgcgcactgactttgcactgactctgcacgcttgtgtacgcttgcagggacgaagaagttttccccacaaagcgaaagtgtgtggggtccccggaacgccaagacttggtctcggcagaactccgggttgggacttccctttggaacagttgcacttgccggttgaacggcgaaattatcttttcccccatacgccaagtaatttctctccggagatggactgcgggttgtggactgcgggttgtggactgcgggttgtgtactgaagattataaaaaggagtgaatatcccatggcatctccggagactgttcctccagagactcgagctcctgcctgaggaagttacaaaaaatggctcgcgtcgctcagtttgtggtttcaggccttttggctgccacagtggccaatggtcaatcatttgacgggactagccgaagtgaagatgctttcagttatgtccagcccgagaacacaaccattctgggcccttacggacactcccccgccgtccttccctcacgtatgtttctcttcgatagttctctataactgggattttgctgacctatgatacagcaaatgctaccggtacaggtgaatggaaggaagcctacgccaaagctcaagagtttgtcgccaagctcactatcgatgagaaagccgacatggtcactggccagccaggtccgtgtgtgggaaacattgttgctattccacgacttgggttcccaggtctctgcttgcaggatgggcccctagcaattcgggttgctgactatgccagcgttttcgctgctggtgtcaccgtggcatccacgtgggacagagatctcctctatgaacgaggctacgccatgggacaagagttcaaggccaagggtgctcacgttgccctcagccccgtggccggcccgctcggccgttctgcctacgcaggccgaaactgggaaggctttgctgctgatccttacttgaccggtgtcgccatggagaagaccattcgcggtcaccaggatgctggcgtgcaagccactccaaagcactttatcggaaatgagcaggagactcagcgtaaccctacctacaaccccaatggaaccctcacggatgtgattcaggaggctctttcctccaacatcgatgaccgaaccatgcatgagctgtacctttggcccttcgccaatgctgtgcgtgcccaggctgctagcttcatgtgcgcataccagcgcttgaatggttcttatgcttgcgagaactccaaggcactcaacggcctgctcaaagaagaactgggtttccagggatacgtcatgtccgactggggtggcactcactctggtgtctcctcgatcgagggtggccttgacatgaacatgcccggtggtctcggtgcctatggtaagacccccggagttggttctttcttcggcaagaatgtgacatatgccgtcaacaacggaaccgttgatgagtcccgtgtcgacgatatgatcatccgcattatgacaccctactactggcttggccaggacgaggactacccagaggtggacccctcatctgccgacctgaacaccttctctccccgttcaacttggatccgcgagtttaatctcaccggcgagcgaagccgcgacgtccgcggagatcacgccgagctgatccgcaagcttgcagctgaagctaccgtgttactgaagaacgaaaagcaggccttgcccttgaaggctcctaagaacatcgctatcttcggcaatgatgccggggagaacacaatgggagctgtgaatgaggcgacattcgaattcggcaacctcgctgctggcggaggctcgggtaccggtcgctttacgtatcttgtctccccactcgaggctatcaagacccgcgctaaggaggacgacgctcttgttcaatacttcttgaacaacacccagattgcgactaacaatgtcaccgatctttgggtccccgctacccccgatgcctgtctggtcttcctgaagacctgggccgaggaaggtgctgaccgtgagcaccttacagtggactacaacggcaacgaggttgtcgagtctgtcgccaagtcttgcaataacacaatcgtcatcacccattcctccggcatcaacgtcctcccttgggccaaccaccctaacgtcactgccattctcgccgcccactaccccggccaggaagccggcaactccattgtcgatgtcctctatggtgatgttaaccccgccggacacctcccctacacaatcgcgaagaacgccaccgactacaacgcccctcccaccaccgaattgtccaccgatggcacgcacgactggcaatcctggttcgacgagaagctcgagatcgactaccgctacttcgacgctaagaacatctccgtgcagtacgaatttggcttcggtctctcgtacacaaccttcagcatctccgacatcaacgccgaacaggtggccgagtctatcccctctatccccgaagaccagcccattcagcccggtggaaaccccgctctgtgggagactatctacaacgtgaccgtcgcagttaccaattctggcgacgtcaagggtgctaccgttccccagttgtacgttaccttcccagacagcacccctgagggcacaccgcccaagcagctgcgcggtttcgagaaggtctctttggctccgggtgagtcccgcactgttggatttgagttgatgcgcagagacctgagttactgggatattgtttctcagaagtggctcgtccctgagggcgagtttgtccttagtgttggattcagtagtcgtgacctgaaggaggtcgctaagattactcctgtttctgtttgaaccctgtatatagagtccgtcatcagtgaccagatagcctggtagtacatacgagatttttattttttttccccagtgtttctaccagttttttttacgttctttgtgccctcttcaaacgtttcttagaaatttgctcaattatcctccagtatcaataggaaagaagaagtttctgtagttttcagacgtgatatattctttaatcaagctcgaaatgagtcggattgtctctacagctgtgacttttcattcggtgccacattcagccgttgaagacgatctgacaacacagagcccttcaccgggaactgaaagtcttgcgctgcggtttacaatcagcacaactcagaatcggagaaccgaggtcacttacgatttgccaattttagcttcgacatctcacgaggaccagcttcgccctcttcgaggccattgcattgtttcccttcctcgacagttcgccatttccaaataggcgtaaaccgatcggggactcgttcaagctggttcttgacatactgcgagacggagtcagatattctctctgcgtatgaagacggcgaaacttactttaccaagaactggaaggaatttgaatccatgacccctataacattagattagaggatatacttatatatcaagacccaagtacccacgagccacctgtgcagatgaatagggagtcagagtagccaggcacataatcgattaagaactactggaaattagtattgttgatacgatgcatttttgggctcatgacactcacctcgttatcaatgctgtcagtgtaccaacacaactttgatatatgttagtgacgggcttttgagaacctgggaactgacaaacccggctatcggtgaagccaatctcagccaactctggaaacagtccaccgatgacttgcttcatgagccctaggccatataggggcacggtattgattggctcagggctgtatttcgttcggggtgttgagattcgactttaaccaaaatggtggtaagcacatgatcttcgacggaaaattatagcatcgggtcaatcgtacatgttcccttctgtggggtgatcttggaaatttgtgaacttgaggcagacaaagtcagcgcacgttgcaaagacaaaagcgacaagagtcgggggataccttccgcgcgcggaatccgaacttcaatctcccttctcgagtgatagggaagccgcccccttcataaccactattatgccggttaactattttgagtccaacctgggtgagaaatgagctcttacccttctccttcgccttgaataaaccgccagacgggaatattgtctggatgaaacttatctcgcaggtctttccgatcttctggcacatcgatgaacataacagttcccattgttgcctcaaccgagcgatgtgcctctggaagaacagctgctgtccaaggaccacctaagttcacatgttagtacggccattggattaccatgggttgttgatcactcacatgcaacaactacgaggtctgcagcgtgtgctaatccatcgcaggttctgatgcctttgattctcttgtctgaaccatttccctcagtgatcaaatggtcaagttcaccatgaggacggcccaggacaaacttcacaccggccttttgacataaataccgcgcatacacgcatgcctacaaggaataaattaacgcttttgcagggggaggtaaagagatatttctcactttgtcagccaaggtgattccggagcccgcatcgagaaatccattagtgacaccatctttgaacttgtcaaacagatggaacttcttggcccattcgggaccgtgtgctccagctcgcttttcatcatcggtgttattctatgtctgtcattaacaatgccatccaactaggaaatcctgccgcaccttaatgaactgcagattgcggaaactaggcgccgtgtcctccatcacgcgcagattctccacatagcgcgggatcatggttggcccatcggcgagatgatacacaccgcatagtgtgagcaattcatcttctggagtcaacggtcgcggaagatcggatggatgactttctttgatagcccggttccactccagccaaatatctctggcttccagagcaagatcttgcgaactaaaggtctgttaatgacgcagccggtttaaatttcgattcggtgtactgactgttcttgtgaaccgtatgttgcacggaagatcttgttgatatcagcggatgcaccatcgcagccgtccgcagggttgtagtagttcgtgtcgaagttgcagcggtcgaagattgtgacatctgtgtagccaccacgggcgagccagagagcagtgcttaatccgaaaacaccaccgcctacgatgatgacacgagattcgggcgtagtcatgtcggacggttccaaggagcttgtcttttcagttcgagattcactcaatttattgcaggatacaaaatgaggtggcatcagtggtgttttatttgctctttaaacttgacgatatgcaacggaattgccgacgaaggagctatctatgcatgagcggcattcccgtcacgcactaaaagttcattcacccaggtgtttggattacgttctttccaggtaagatacttgacataatcaaataccttccaagatagtatgttttagggtggaacgtggccattatgcggcatttccgttcggagcaaagcgtggagatcccttgatatacggtattcatcccccgctgcttgctttgtctcgcaaataaatgataagctggctcggccaatcgcaccaaatgcacctttatctctgttcttttttatctgacttcatatatgcgcggatttaccgcaatgttggttgacaggtttgattccccgcattttcgcaagtgtagacgtcgggattgcagtaaagttatataagacaggccttgtttgaccattcgaattgccagccatggaaaatctcagtccattttgattcttctttccaattatccgatatctcttccacacacaagcacaatcaatccatgttcacgcattgagcatccaacatgggcttcacgaacatgctcggaagaaccatgctggcggactataacaggagaataaaaaatgcaccccgcgaagtgatcctgagtcctagtctgcttctgtcgtgtgcgatgtacgcgaccgcagccatccctttgagtgagtcaacttcatcgctcgaatttatgttttagccttactgaccatcgtacgcagcatgggatcaaggatcagcatccacattgccgtccctagagggctttcaacagcagttcggtatcagctctacagcgggtgcccactcgaccaggaactttgtctcccttgtctacatcggtgacgcagccggtgctgctctatcattcttcataaacgacacaattgggcgtctctggtctttccggttatacaccgcaatttggattattggccagctagtcgcgactttcagccctggaccatcggcattgtacgtatcgcggataatttctggactgggcattggatcactcagtgtcacgggctctgtctctattgttgaattggctccacctgagatacgcggactcttggcagcatggtacaccgtttgtatgacattgtcccttatgctcgctacattttgtgtgtatggtgtgcagctgcacattgcagcgagtcgacttcaataccaggtcgtgatgttctctccctgtgtgtttatgttactgtggatactggcaagtttctctctctgcgagtcacctcgttggctagttctctccaaccgaagcgaagaagccgcgaatactcttgtccggttacggcgcttaccgctcgatcatgatcgggtccaggaagaactccgaagcattaaagaatctatccaattggagactgcagctcatgaccccaatgataaatcgccctctaacatcatcagccttgcaaaggaaacattcacagtcccttcaaatctccgccgagttcagcaagctcttatcctatatgcgtttccccaattctcaggtggcaactctatcaccaactattttatccctatcttgaaaattatcgggctgaccggcgattcctctcgaaatttgttcctgaatggaatgtacaccatgacgaaattcttcttcggcctggccgcatcgtttttcttcatcgatgctttaggtcgtcgaaatacgcttttcttcggcattacccttcaactgatttctgacatctatcttgcggcatatattaaagttcaaaacgatgcatccccctctgaagctgcaggcgaggcggcgctagcatcaattttcatccactcttttggatatactatcggtgaggttaaaaaacaggttcaaatgcgcactggaatctaacttgaaggacaaaacacaggccttctaaccctcccatacgtctttggcggcgaactatggcccaatcgcattcgatcctttggtgctgcaataacacagacctttcattggctattccactactccatgacattcgcattaccgtcccttctttcccggacgaataactggggcgcctttatattctttgcggcttggtgcgccgcagctcttctatacgtatatctgcttgtgccggagattgcaggtctcagtgtcgaagagattgaacgtgttttcagcggaccgtggcgactcttcggtaggcaatctacgttccgagatacatcctctgttattgagggccaggatgtgaaccataagtcgtaagatcttctccgagtttaccgatcggccaatggctaacttgcaatagagagcacagcaaagacgaagcggttccagtgactaaatccgcgcagaagtctgttgaggggtcgcgttcgtcgtctcactaggtattttgttagtataattctatttcacattactttggtcagtcttcactcgggagcattatacgtatttcccgtctttttacttgatattggggtaatgcagtatcaaaacagtacgtggtagctttgtccatccacagacgttaatgcgttcccgcattgtgattggctgtagacatgaattcgacggaattaccgtggaaagccgacaaaagcggggaagcggcaattccgctctttccaaacttggaaggttgacttcattcagcatccagttgatcggagagccgttaaggctggggattgttatcagcagccaataaggctcgtggctttatatacatgtatgtagcaagggtcaaatgtaggttatgaatagctgtcacgcgacatctaaatgaacttgacgtcgagtacaccgtagggcaagtgatcaagaccgaaccactcaaaccagaaatatatcatagacagtgtcgaatacccctagcttcggccctttatctcaaaaggattttgtggagacgtttcccctctctcatatctctcatatctcttcgggctaccagtcgggccaaatccccagcgaacactagtctacgtttatcttccctcgttctcatattcgatccccaaccccacttgagctacgcttttatttcctttctgtgcgggtacacctcaccgcttaaattctcgactcttcaaatccctcaacaaaatgcaagaatccgaagccctcgagcagcatatccaatcccggaagtgtagcccacaaaagcaaaaacaatctcggcagatcaatggtagtatccaccggagaagcactaatgcgtgtgagtatccactgtacgccaagatctggggtactccgactgagtgtccaattttaggtcgctactgcaaacgaaggaagataaaatgccattacaacatcgagaacatgaacgggtaacttgatcgccactataataagctcgtgggggcttgactgacctgttggtagtaaatgcgtcgcttgttccaagtcaggtgcaggtaaaatacactccctttactcgtcttgaagcacaactgacctatattctagaatgtcacttcgatgttcccccagacggtgtattgagacgcgatgcgtaagcttttctgctactcacatcgttctaccgctaaagtttgcatagatatgtcgcaacgcttgaatcacgaatcaaaaatcttgaaaggcaactacaagcaagccgattccagcaacccacatcgaccactggcctttgtcttactcccgagacgactattcctgaacctcgaactcatggaagtgatgcctccacttcaatgtcgcaggatcgacgaggagttcttcaaaatgacgagctttcggcgaatgggagcgtttcacaatacaatgtaatcttattttgtcatcaacaaattatttgaattcggaacactactgatagtcacatcaggtgttaccagatatggcacaagatcaatctttgaaatctcaggaacaagtgcccgggtctctatttgggaccagaaatgatacgcaggtgtcagatccagacgtcaccatcctcgagatggtctatggacgtacatttgtcccggagacagaaattgagtctctccctatgttaccctcgagcaacggtgccaagaaacttgttgatgccgcgtacttttatacccaagctcgatactgcatcgttgactggaatcagattagtgtatggcatcaacaaagagacacaatcacatatgtttcttctcaagattcgatagaatcccaaactggtaaacatcagccatgtgattgagtttaagcacaatgactgatatcacagtaggggcctttttcatctggataatatatgccattggagcccggttgatcccggaccccgagaattcaacagaggtatgtggctgttgaccggacgagaaaaaaaagccttaactaagtgtgataggcattttttgctcgcgcgcgaacttatctcccagcaataatgtccttacaggacatggcgacggtgcaagctctgctctgtcttgtgcagtattacttcagagcccagaccgaatctccaatatggttcgttggacgctatttttcaagaacataatttgctgatgttatgactaggcaccttgtaggccttgtcttgcgcttgtgtgtcaagctcagataccatcgtaaacttgtggcatctcctgaggctcaaagtttagatccatataccgttgagcttcgaaagcgattcttctggtgtgcatactgttttgatcggtgtgtatcaggtctactccaaatgtaaccttacacgatgaaccaacctaacgatcgaaatagatcgctggcgatttggtccaagctcccgttcggaatcagtgattctgatattgatgcagaggtgtgtgctccggcttgaaaaatgtcgctctttttgaccataatttagataccaattgatattgacgacacgtgcatcgaccagcacagaattcgacaaatgcaactccaaggaactggagcccaaggtaaagaagaggggatgatcactacggtatgattaatttgtttctactcgctcaatttcgaggtcctaacacttggaacagatgaccgctgctttacaccatttgcatgtgtaccgcatcagatccaaaatattgtaagagatcctctaccacatatatggaaaatgttaaccctctttagaacgagatttactggaccacatgctcaagtcccatcgctagccgaggtccaaagtcttcttcatgaactggatcaatggaaacagcaagcgcctcaaaaacgagactcgaggcccttccctcagcaaacccctgatcgagtacaggctacgtacacacaagctgttctcctcttaatacgacccatattaatggccaatgtaattgaccccgatttaataggcctgtgtgttgaattcgcagttgaagcatgtcaggtaagtgatctacatcttagcaccgatgaagctatcttctaacaattcaacagaacgcaaaatccttgagcttaaacccccaaacacctccggatcgcattacagtgtaccactgcttttattgtggtgttaccttactacagtgcttagcgataacaccaacggcgttaacagctcggcgcactcaccaggcgataggcgcttgtttaagcgcattggctgtatatactcgagtactgccagctactgcaccctttttgcggttgttcgaggatctctcgaatatcctgctctatgacgacaacggggctgatattcatccaagccccgaagtgcgaaatgcattgaacaggattgtttccagtgatccgtcagaagcatcagggtaggcggagtgagatcttttgttgtaggtttctaactttggacctgtaggatcttgcattcactatcaagccagaaaggccaagaagcgacatctaggtcgacaccggaaactcttgaaatgggaacgatggtacgtaaataaatattctggtttccagtcgtatatcacttaacaacttttacctaggcaactcagtatgactctattctgggtggacagtcctccgtgatattagacaccgactttctacttgagatgcctctggatatatctccactttatgcgcccgatatcgaagtaccggaactgtggactgagccgtggcttcggctttcatccacagaatatagtcaatagaagtcctccaaacccctgaaagtgtgaacagaccacgaaggattttcgtggattgggcttatcaacttgcccaggtgggctccattcatgaatatatgtactacacgtatacggccttctacgagtttgcgaatacaaaatgtagagtttacatccttcgcggtatacgtgaagcctcaatataaatcatttgatatatagcttacagctcttgttccagaagagatactacaccctacactgtgacatggtcatttaacttgaaggttgttttcctcagttgagccaaaagatactaatttctcttactgatggccacgctaggggtgataatcacgtcatctctccgcaactactatcaatgctgtgaagcatgaaaagagccctgggagacgtacaagtatgctatcaatgacactatgaacaaaagaaaagggagcaaagacgatatctactccgcagatatggacaaacgatgtcacgtgcgtacattcttcgtgtcacatcccctcatcccacgtctgctcaactttcaatatacctacctaggtagacatctacactggagaccacagacccaacaaagaacagcccaattaattcctcaccatggacgccaagctagtcctttacgacattgccatgggccccccagccgaaaagtacaatagcgccgtaaacccttggaaaacccgtctagccctgaacttcaaatcactcccctactcaaccaattgggtccaactgcccgatgtatccagtgttcgaaaaagcctcaacatccccgcgtgccgcaaatttgccgatggcacagacttccacactctccccatcctagtggaccccacaacatcccgcaaactcggcgactccttcgacatagctgtctacctgcaaaagcaatacccagccgggaacgatttattcccgccccagtccctggactacgtctttagtccggatgctgcaatcttaattccattgtctgagtgcgatgggagtgaatacccccaatatgcgcgtttcaatgtgaatatcgatgcagctttcaccacgcatgtcggactcatggcctacgggctaccgtttgatcctgcgactgccgaacaggcaaaagctgaatttgttcgacgggctggtgtgagctgttgggaggatttggctgtaacaggggaacagcgtgagaagcttctccggtccttccgggagatgttgggtgggctggcgaagctttttggtgggaacgggccgtttttacttgggaatcgggctaattacgcggatcttattgttggggcttggttgaggatggcgagcaagactttgcctgctgaggagtgggggttggttcgagattggcatggtggtattttcggaaggctgcatgatgcgttggagatttatgcggctgttcattagggattttgctcttggtcccaccaccaaacattattcgactggcagccaaaaacaaaagcaaaaataaaaacatgcagagagattcactggtcacctattttatgaattgactgccttgtcaaacttggttagctctagttgtccttggcatcaagcgcttttgttatgtcggagcttggaaatttccctcatctattctaccttcgccaaaccaccaagtctaatctcagatacgtaatttgttaaagaccttcctctcagtcatttacaaacatggaccacctccgagatagactttacagtcacccggtctgggggcacgtcgtccgtcgcactacctactctgctgaatccgatgctgtattcccaggcactgttaggtatattgatggccgcatccggcaatcattttccaagacgccaaccagaatcctaaactcaatgattccaatgaaatgtgggccaaatatcgtcaactatcatagaagatccaacgcgactcaggagagcggccctcgaggtaattcgcgctcatttcgaagcctgggtggatgaagaatccctacagacgctgaaaaggatatcggcggagtaccttgcaaatcaggggccagggtattcgtgtctattgtaaaagtggtttattcgcggaatatttcactgtacccaatagtccatatgtgtattagagtataaatagtgctttattaacaagacaaatatcaattccaactccttcccatctataccaacgcccaaattttactgaattattaagtcgaaacgcacgtggtgattgatctagggccgattgagctgttcacggcgataaaagagaaggaagccaaagctacaatcacagttagtacatggccataagatgagagaggatgggatgataactgacctagcgagaagctggaagaaaagggcgatccagaaccacgcattggcaactgcgtccagcgacgatccaacagcaggggagatatctcctggaccgaccttgtttggtgcaaatccgcgagcacaaattgtggcgatagacccaatagactgtgcagccaacaggacgaaaacaacgtgtactcttgtcaaggtctgtaggagaatcattcccaaaccgacctgttgaatctcgtcaagaacgccgagccagagccagagacaccgggatgcgatagctccggaagtcatacctccagcccatggaagatagtagccgatattggatgttccccaccaagtttgcgcccatcgtggtgcaccgatactcaggccgaagaccggtaagatccaactgtgctccttggacaagaagcggaagagtagcatcacggcaacccagaggacaataaagaagaagatgaccaggagagcaacttcccatggtttggtgtgttgggaggaccagaggaatgaccagtttcggccgaatgccgcggaaaggaaccagttctggacgatgaccatgaagaagaaccagaggacgattcggcgacggaatagagaagtgtagaagaagaggatctttccgggcgcttggcgataatactttggcaagccgagagcgaggagaacaccgataaccaagcaaactgcggcaatgggcatcaccacagctgtcagtctccaggaattcaatgcaactgtggaaacacctccaacttccgcggctgtgaccctggaactccagtaccacagggcaacagtgtagagctgtgagataccctggataagacttgcgcggaacatccagtctttcacagggacggcaccctggtcaccaaagttgagagcaaagaacaaagaaccactggaagatgctgcagcatagatacctgcggcgacattctgagcccacgcttgaccgagttctgagagtgcgaacggagaaacgccgatggtgatgaatgccatggaatatatgaaccaggggagcgtgaggactatgacagaggggaagcggtagaagaggaaccaccaggcgatggaagagacgcagtagattgccgcgataacgtagagcttgactgccgtctcaccaatctggccagccaaaagtgtgatctgcgcagagttggttgcgatgatttgtccgagacccaagaatagagcataaacaggccagtttccgacgcgccatctcataaagcgctggacggcaatgggtctcttgtatcccagacgagcgagccacaaatcgatttcatcattgttgttcgaatccgagtcttcgggaccttctgtgacgaggttgtatggtgtgttctcgacagcattgtccaagccagctccagtcgcgggacgttctttgggctgcttcttcaactgcgcatcgttgtacatgtagaagaacttccgctcggacttcatgagataaagctcaatacaataatctgaaattgagtttttcttgttgaggttggtgagcagctgttcgaagtgccgggtgaagtggcccatgctgtctgtaaaggtcgggtcgaccttttgaagatggaaatctggttggtcatggtcattaacaacagaaggcaatgagaggacagagatattccgggaatgagcgaagggtgcagctggatcagaaagagcaccaggtgccctcaccggggaggagtcccttgagatgaaacgcgatgactccgacgccgacgagctagacacaccacgggagtggttgctgtttctagggtgcgaggcaagatcctggagagggaaattgaccgctgccatagcttcttcttgggtaataaggttctcctgcggtgtggcagtgccctcatcatcggcatcagtggtatcgccgtcgacgggctcgagcatctgactttcgcgcagtgacttcttgacgagacgctttctgccatgccctggcccagctcgtcgaccgagcgacaggttgcgacctaacgtgctacctctgttgttttcggctacctgcatttcctgggcttcgactgcctgtagctgtagaagggatggctggaagggctgcgatgttcttcctggtgtatccaaagcccccgtcgctgacgaagggcgggaagtcattgcggagtcccgcaaaccaggtgtttcccagtagatctgagactctcgtgctgagcctgcaacggtgagttgattcttctggtgatgaatgtggatagatgtccgctgcaaaacttcgagcttctgaacccactcgagaacggggaatcgttgcttggctgagtttgcacgcatctcctctcgggtctctggcgtcgattccaaagcagactttatggcggttctcaactggtgtaagagatggcgggctgagtctgattccacagtgtaccaccaaccaggcatctggccgagaccaccgatgcgggagccgattccaagtgcacccttccgaccgaactcaacggcaatcaatccgaagggttcgtcgcgggatgggatcagggcgaagtcggcaccagagaacacgaaggggggaaggactgtaaactctggcttagagaagacacgtcctgggaacatttccatgatgcgctgcagtttgatagcagccagcctaccgtacagatcgataataggaccaatacagattagctgcacattaggtctagcagacaagacagccggcataacgtccgcaatcaagtcgactcccttctgcttcgaccatcttcccacgaacaccagtaagtcagcgttggggtcctcgttcaaaccagcccatttctgcgcttggattttgtcattggccagctcgtcggtagactgaatcgaaacttgcacgtcggggtctttcttcaaggcgcctgtatcggagggatcgggattggggagactgccaatcttgccaagactccaaaagattggataacgggcccatgagcgctttccatatttctcggacacaccaaccgcaccgaagccgcgttgatggaatcgcaaataactagctccggtatgaaggaggttgaaaacgttgccgaactgacaatatttggtcgctatgtcaaccggaagattgaagacagaacagacttctttcttctcctgtgaggtcctcaaagcccaaagaccttggaactcggcattgtgcaatgacagacaaaccgggatagttcgcgatgggagtaggtaaagtggtgccacgcagccatggaaatcgttgatatgatagaggtcgatagagggggtccgcttcattacctcggcgatacactgattccaggccgaatagtaaatcgcactgtcaagatcatccatacgtggaggataaggctccgccttagtctgctgccggaaaacaggagcatcaaggaggacgtaggtgatgttatccacaacgtgatactggacttgcactgaatatggatgatccaagatcgtcaccacgaaaggttcagcaggcgtatcctcagggtaatcgatatcaccgacacacggcaccacccagatgagattctggtgcttcagattctgtgacatgagctgggccattactcccagaccgccgatcttgaccttcaccttccagtcttgaatgtcgtactccatagtggcaatcaatacagtgcgtcgctggtcgctcgctcctgccagagccatgttcgtaggtaccgacttttctgccatatcgatctcctcgacatcatctttggcgaaagttcctttgagtctacgccaaagtagtaccgaggagttgtcggccttggtgacattgccattcttgttgagtttgacacggtagaagttcgagatgaagatgaagacaccagcacaacccataaggatcggaataacccatagaagaatgaagaggaccaactgggcccatccagacccgacgggaatcatttggtatctcagattagcatcgttgagggagatggtccagccaagatgtgggaacggcggtggactcgtgatgttgatcacgttcgatgagagataggacggaggaagcttttgaaccgaagacgagttgccgacatcaccgtagacctcggtagtatcaggggcaccctcactgtccgctccccaaacatttaactggcccacggctggccattcgtaaacgaagtcgtagttccagcgagacgttttggaatcaaatctcatcttgctgtctattcccgaatcgtagccgtattgattgtacgggccgttaaaccacaggtgcgggaatcttcgaactgtatcgctcgcataatcgccttcctgaatgtaatcactgcttccagtgagccttgaaaagtactggacccggatatgagtcccctcccactttcgggagtccgggccagcgaaaggcgggatggtaacagtcgtgttgccacctaaataggtcgtccagttgttccagctccggccaaagtcagacgagtatcggaacatgtccgcaccggcagctctgtgctgaatgtaaaagtcgtcgttggacttgtggactagggtggtagagtaattggcaagtggagaaatcagggggttatcatgagcaccgaggcggagcaagaacttgtcagtcgaattggtgtaaaccccagaagaggaaacatttttgaccgtcagttggtggattccatggtggacatttttcaggcttgcagaccatgtccaaacagtcgggacttctccaatgtagttatgtcgcgaggttctgggagggactttggtgcagttgacactagatgtatcaagctcggcagtgatgtttttctcagttttagaattcaaggacactgcctttgtgatgctgtcacagtccatttcggtggaatatccaagctgaacggacacggtttcaccgctgtcgtctgtatatatcaaccgagcatcatgcccagggaagaaatccgtgacggtagggccgggctcaacgaagtgggtggtcttgacataggcacggtattcccatggaagcaactccattttacggacgcatccgtaggaattctcggagttggctgggccatcttctaaagtgagttcatcgtaaggatagaagaggttcctcagttttgtccctgagtcaaatggagccaataaggacgaattcttatcgctgcagttgcccccgtatgtctcagtttcgtttccattttgatacacaagccacagagtttcattagcccggatctcgtttgtctgtactccagggaaatagctccgcaagacagaccaaaggccagtgaccgtgggggtggtatcagagccaggaaggtagaggtcttttgtgagttgagagatcgtttcgaggaacagaccatcctgggccactgggtagtgggctcgaatctcgaacatacgcttcatgatgttgcgcagtggatgggcaggattccgctgatcgtacgtgacagtgatatcattgcaaccctcgcgtcccttctcgatagggaaatcatagaactttgaggtgttcaagttgaagcagccctgtgtccaccatgcggtctggtaggtcatgggctgccggccgaacatatagttggatgcagtagcgtcgaacacgtacatgtcctgctcttctccccataagacaagagggattccaggaagctccagcgagatgatatataaacctaggaggtatttatctgtgccattctggaccgctggccagcggaagttatcctggttcgatacaccatacatatgcctggggtccacttctcctgtgaaggcattgaggaaatcgttggttatcaacatctgattccaggcttcgataaagtcggtaggcaagtcaaagccggcaaccaagttaccgtccatgcctaagaagcgggtcatcgaacggtagatggtataatgaaatgcggaggcatctagagcttgaaggccgtcgtctcttaggaaagctgactccgagttgttcgtaagcttgatgcccgcgcccgcattggccgcacgctgatccggctggcggccgcggccgaggtagagagcgccgaaggtgtcaccggaggtgatctcgccggggaggaagaaattttccttgccaagtttctttgcgcattcacggtagctggcaatcatttcgcttaagggctcgagggtcgcttgcacagacttatcaaaccggaaaccgtcgatatccagactcgcgatttgaaggcaggaatgttgaataagcacatcgcggaccggcttgtgccattcacggaggcgatcctgcacggaggcaaacttcgtaagttggcgttgccagtcggggaagttgccgaacgcctctagctctccatattgatcgaaatcgctgttatagcaacccctcaaatcttcaaccccctcgttcgttaatgggtatccggtctcatcccagaacttgggatagttacaagtctcgttatactcgttaccgaatttgaaatccacatattctctgtcggtaacccattggacttcatattctgaagctttgaagtcggcagaactgttcagatggcctttgaatccgatcaggttgctcattctgtgctttaagatcagctcatgaatatccgaggatctagggcatcgacttacgttgatattgtgttatccatcaacacatacatgtcccgtttgtgaatctcatcgatcgtccgcctccagtcctccagtgttccataatgcatgtcgaggagagtggtatcgaccggcgagtacccatcgtaggcccagggcaagttcatcaagtacgttccggcgaagtagatgacctttttgaggttagcggtagactcattacgaagctgggtcaactaaccttgaatcccattccctgaatatagtccagcgtatctaccaggccgtccaagtcaccgccgtggcgcatctgattagaattgatcacatgctcaaatgcggtgccattgatatcatcatttgtggggtcgccgttggcgatacgatccaaaaagatggtatatgtagggaggcgccagttatccggtgacggatgatagtcatggtccggccatgatccccaataatcgattgggccttcagcggatttgttctcatttagattgtatttagcgagtgattcatcgtaaggccaagaaaagccaaaaacgctcaaaaacgacagtatgaggaaagctgagcgctgcatttccgtagatgatgctgttatcagcaggaacctgctgccggaaaaatgcgcgactcaaagaacgaatgaaatgagtctttgacagatagcgagagtgagatgaaagaacaaagggaaaaaaattcaactgaaacaggcctttcgcattttacttgattactgattttctaagattttccagaatacatttttatggagaacaaatccttatcgggccgaatggatggtctatacataggctgacccacgtagcccacccagccagattttatctatccactgctttttgccgctgcatgctttttgggcccgtgtctcaggttcttccgaaggggttgaatcattcactacagagtaattgttaacaagctgccatgggttgtcgtgatcctagtgcatccacctaagcacttgaacttggcttccgttgcacggcatattccagttggaaaattcccgggcttactaaatgggcattttaccaaggtacatacctaggtaggtacataggtaggtacacaggtgcggagtatgcaaagtgcagtccttagcgatacgctgcatcgtcaaatcacagcggtgtggctggcacatatgtacgctgtatggcggcacgcatttgcgatgagatatgtcctaggtcaaagcaccatatttctcttattttcactttccaactgcatcatgcaatgcaaccgataatcctcgaggcttatgttctttattattcgagaagttgtactcctaggtaaccagttgttctactctgcactcaaaaacgtgtaaacgatatgggagagtagatattaaggaggccattagttggaacaactatctctactatttctataaaaaatacaaataaaatgaaaggtacacaataaacctgaactagacatcctattttacgatattttctacgatttcggtcaaagttggtctgtcggtggacttttttttcgggcccacccgccttcgacgtcacatcttccgtcagtttcagaccactatacaatgtctcgaggtgaatcagggtgaaaataagaccttcaaattccctgtttgatggagtagactcctaaattaactatgccccgagcctgcttcaccggtttcttcgcttgttcctatgcatacgaatctgacctcccgtgtcttagatagaagcgagcgaatccacacatatgtacctaacgatgctgtcacccttctagttacaattggaaaagtcacctattcccagtgattatgtgccagtaatttaatggcgaggctggagaaccgtatagaataactgatgatcctggatggccatcatcatgtttttgtttttgctttttcttttttcttttttctttttttgccgcgcccaggcagtacaagcttgtcgtgcgcggcctagaagtcgcaccagatgcttggcttcaacgtcctagtcgtattctcaatcgtattcgaacggtatgcctggagcttgtttaatgttagtctatatggcgataccaaacgagcgaaagcttccacctacatctacatgatacacgataacccgatacagaataatgtaccgataaggttagcttaaatgtaccgagggaacggcctcacagtcttccaaggttactaaatatagccaagataaccaagcaatgattgggccaagcgacccacaatatttattgcttgtctcgattcgcacgccccaatcagagtggatcaaagttcgcctcactcttgtgatacactcacggcacattagaaacacgctagggcatatatgatttagcctagttccagatatcgtcatatattgtacgaagtacgcaaatgtctcatatgccgcattgaagcctataaagaggataatcagggcaagccaaccaacataattgatatatattgtatacgaggctccaccgacatcatccgattggggctagtttcactatcagtggggcaccgatttacgtcggtggatctgtgcttacagtgaagccaaccaagtgttggcactgaatagcaaattttcagatggcgaatcccaagtattaataattgcacataaaatatacagaaataccacagtcataacctgaattctcctaaccttcagattagtgtgtccccaaaatagttagggaaaaatagatatactaagacatatacatagtgtagaagaattttcaattgctaaacttcggaggttccttgaaggttccaaggtctatgccatgagtacctgggcatgtacctacatatgtatctaggtacctatgcttcaaaccatggaaagttaaagcaagagaatggttcaacttctatatacaacaatgcttacatgtggtgttgttaaggtgctctttacacttctattagcactcgaaatcccagttctatctacgtagccgctatacgatcgtactaccgaacactgctaggcggattttcatcatcattcgggttcgccacgattacttgacacttcgatctcattgctctgctccctaggcattgacctataagcagacttgggctatccaagattttctcccattgtttgccggctattttcaatcggcggttccacaacaacctgtcttagttagctagttaactacaaagatttatattgaatgccttctatctcgggtgtcgacgtcttcacaacgggaaccctaaaaaacttgttgttctaggagatcagttctccagtcgctccattctacgcacattcagagatataagggaggccatgcaatagctgattcttgcatttgtacatctcaatgcagttagcgtcaatctatttggtgagaaacggggctgtttctttcagagtcagagtgatagtgatagtgactgaatgtatataacccgatttggaggcacaaacgctcatgctgaacttgagtacagggtccattagggtagttgctgcgttaatcgaatcgatgttgcacaaagctgacctttccccactagtacaaagcggaagtatgtcatggtacgtaactactgaacttggtgatcaatattagcaagtcccggcccattacagcccaacttccattgaggctgctctttctgggccgagtcgagcgttcctgaaaggaaagactgcacgtttcacaagaacgttgggtttgacgtaacaatagttattaggtaggtccgaccacgcgaacttatacagcaaaaattattcgtaatgcatggctaatgtatgtggctttataaggttgtggttaatctattgacctgacccttataggaaaagatgggcgaggtttcacagaataatatatattttatatcattaaccttaagcaacctcgtcttctaggaaatattgcatcaccaaccttcatggtcgattctttgataaaatggagaagcattcgaggcggatgtggcgaagctaacaacaggactgcactagagtctaccacggttttttcaacatcacctaggattaacactgagattctggtggttacataatctttacttgaagtgaaggtttatattcatgtgtggcacatatttaaagtggtggagattcgtgatctagcatacaagccccgaaaatttggacgccatggcagacggctcacccgccaagttcaaaataacagagcatgtgattgatgcacaatatattcgggaatatcccactgcgacagtttctcaagatgctgctttaaaagttgtggtgaaaaagtatacacctgtggacaatccaattcctcagccaggcgacgtaaccatcatcggggcgcatggactcgggcttccaaaggcaagtaaacaatctattacttgtatcacaaattttattggctaatcagaattataggaactctacgagccgttatgggaagaaattctagtacaaagtcaacaacaagggtttcggattggatcgatatggattgcggatatagcgaatctaggtgccagcggtgttgtaaatgagagaattcttggtgatgaccgtaggtgtatgtcgttctacatttgaatctcacggttaataagtccagcgtccgtgtttgaccaccctcgtgatattctacacatgatcaatctgtttcgtcacgagatgtcgaggcctattatcggagtagggcatagtatgggtgcgacgcagctgtacgttacttgaagcgagaggacagagtaattaatgctgacatttcgcccactagagctctcttatcgctggtgcatccccgcctgttcacttccctcgtcctcatcgaaccagccattctaccaacaaacttgcccttaaagttatatgcgttcctcacacttaacagacaggacacctggccatccaaatccgaagccctcaaatcatccaccaaatcatacgcacgatgggattctcgtgtcttgaagcgatggaatgagcatggataccgcaatttacaaacggtggtttccccacaaatagatggagaagccaaacccattgacggacccgtcactttgaccagctcgatctaccaagtggctatgctctgtcttcgaccaaacttcatgggccacactacttcagcactagcagactccaccgaagcgcctccgcacgaccctcttatgtaccccgacattatcgaccctccccacctatccatgcccttttatcgaagcgaggtacgtgttttgttcctcatgctagagcatatccgaccatcagtcttctacttgtttggcggggagagccaggtaacaacaccagaggatcaagctcagattctcgagaggacaggtgcaggaattgggggaagcggcggagtgaagcattcccaagttaagaaaacagttctgttagaatgtggtcatacggttccgatggaggatgtggctgggagtgcttctcttattgggacatgggttggccagtctgtgcagaggtggaagaaagacgaactgcgagtccaccagaaatggactaatcattcaacgagggaggttctaactgcgcctgcaaaatggaggcccatgctggaggaggctctaaagtccgaagcgcggaaagaaaggtcgaagatctagtgatatccatatgcttgctttgatcttagttgctttttattgtggattcgaagactctgtacggtactatctctatctgatcttatttttcggttaactacagggctctcatatacttgactcggttttatcaatttaactagcagatatataacatgtaacctacgaagaaagcttaaccaacatgaatgagtacgatataaaggccagaccataatattatatctacattctatacactgtgccatcttctcagacattaataaaaataatgttacgattgatagagtccttaggacacagttcactctgccagtggtcggcttaatgctcgcactttgagcggaagatcaacaacacaggttgcacggaggattaaattagatagcgtgtcatgacaagctacacatgtacaacatcatgtcggagttgctatgcggttacacattactcatggcgagtatgcatccttctgcttgtggacaggatgcaaaggttacacaccatccattgcctcgacatatttacccccagaaaggtgaggcacatagccgattgtactcgacgcacgatatggcgttttgagaacccaaaacatcttgtcagcgaagattgcatcgtccaatttgtgggaagacccccattcgactatgctgtgacatatgtggcatataaacgtgttatttaccatacagcacccccctcttgaggactaatactacagttggaataatatatattcagacgcattcggcgtcttctttccttcttccagtttcccaggttcgcaccttaacatctacaataatcgacgcgaaagatggtgcctctcacatttggcatattcgagtacctgctcttgctactaggcatactatttgcgtataaaggcacgcaggttatttaccgcctatacttctctccacttgccaagtttccagggccacgcttggcagcagcaaccagtctttacgagttctatttcgacgttatcagagacggccagttcatgttcgagcttaaccgtttacatgacaaatacggccctatcctccgcatcaatcctcacgagctgcatatcaaagaccccagctattacgataccctctacggtgggccattaaataagagagacaaattgccttcgtttactcaatcgggattgcccctatcagcctttgagactgcgccacatggtcttcaccgtgagcggaggaaattactaggccctttcctctcaacacaatctgttacgaacctccagcctctcatccaggaaaaggtggatctggtttgtggccacctgtccagaagggttggcacaggggagtttctcgacttgcactctatcttagcttctttcgccgcagacgtgctgtccacgtatgtgcttggccgcgagaattgctatggatacttggacagagcagaggtaacggatgaatggaagaagattgttaacagcctctttgaggcactgcttcttatcaggagtgtcccgtcactattgggcctagcgcacatttttggcaagactatcgcctggatatttcccccctttcattggatcaataaactccagacagtatgtatgtggtctttctccttacactgcgatatactgaccatgtgttaggaagttagtcaacaagtgaaggctgtatacgacaaaccagacggggactcgatgatatcgactattctctccaacgagaaagtacctagcactgaaaaagaactcgagcgcatggcggatgaactgaagttcctgataattgccgggtcggatgcaccgtctcaagtaatggcgatcactctgttccatctcctctggaatccagaaacatgccaaaaactcaaagccgagttagatgaagctttccccgttgtggccgatgcggactggactcagtcgaagaatctcccttatctggtaaggcgtatcagccctatcgtgtccttgcagattgtactaacaataggtgcgccagtctgctgtgttgaaagagggtctacgactttccgcggttgtgacaacgagacttccgcgtagtgcaccagaggaagctttacagtacggaaaatggaccattccacccggggtatgtcttcctaatttatatttcctctatccctcccaccaatcttcttcttctgttgatatttattaatacatcgatgtagacgcctgtcggcatgtccactcattccattctacggagccccgatatctataccaacccgatgaaattcatgccagaacgctggatgggccctgccgaggaagtccgtgtactggatagatacctcgttccgtttgcgaaaggaaattcaagttgcatgggtcaaaggtaagcagtttctagtttctttaccagttccagacaatggcactgatatatattagcatgacctactcgtggatgtacgcaattataggcaccttgatacgcaggttccaattggagcttcacgaaactgatgagaagaatgttcgcattgttcgagactgcttcaatggacagactgttcgggggctcaatttgatcaatgttaaggtcgccagagaattcaactagattgttctcagtcatgcgggtaatcaacctgttcgcttcttgatttagattccaatctgtttcatgtcttgattagctttcagtttttatatcatctcggtccaaattgattgtcacatcttctcgacctaacccctaccattttacccccgcgcacctaaaattgcataatttctgtctttcccacaataagttctctcctttaattttatttacctggttatgcttattttataggggaatggatgggataaatgaacctggcacgggaaagaatgacatgcattactagacgagagaattgcttcaatttatgctatagtcgaaaagggtcccaagtaatataacaaagcctaagtcaataggaccaaaacctacctcgaagcctactactccacatttagaccctaggcccaaaaatataatcccgatcgaccgaaaggcgtccggcagcaatctccatctggtagtgctcagcaagtcctgcaacgataaccatccaacctcgcgtagcaaggtccttgtcacagttcataaccgggaacgagatacaaagtccctccttgtggtgcaaggcatcatagttggtgactgcgcagtcaccagcacggcaacggtcagccacgagatccatcaattcttcatcggaagaaaggcggtcctcagcggaaagcttcacagacacccaccacagctcgggcatgctgctaaggttctcgtagtgaggccggccgtctgagaggaagatggtacgagttcgcttcaaagcgacccgacttgctgcattcatggcttcgagggttgcggtagcttcgatctagatatgttcagctgttagggggtgttaggggttcgtttgcttttgatgaacctttggtaagaaactgcttttctgtctgatggtagaggctatatgagggattctgaggttatttaaatgcgaagcaatggaacaatgggcagttctatcgagagattgcctttgacatagttgacaacaaagcctttcacacaacccaaggaaggtcattataatgccctttatcgatcctttgactagtttcaatgacacccaatgcctacatatagtgtataatggacaaagcctcgaggccttttcactcctttcggttagggatcagagagccaaagaacaaagcctccacggttgtcgatgaacgctataccttcaaggaatttggcattgtaaatgaacgttagtctggtgtttagctcttgcaatgatatttctctaatggagtcaatcaattcaaactaaacataggtagcgtctcgagaaatgcgagcttgatccttgcggtgatatgcttttagtaggcctaaactccagatacaacatcgcggcccagccttatctgattttgctcgggtagaagtctccagcatgcagacatgcgtgagacacgacaaaattaggtattttatgcgtagatgagaaggagtaagatacggcaatcgaggttttgtgcaagaagaatcgtcaatttcacatcgtgttcctcgttcctaaggaagaaagagagaacaaatcccaaagttgcagccataacgacaaaataatcagggagacaaaagagttcattaatcgtgtacttggataccggcgtaagggttgatccatcaaagaaatcccgatgcgtcattttaatgcatgttagataagccgaggcctctgaggtcccgaggtccaaagctttcaataccgcccattactcaacatagttggcagggaaaggccccttctgccctctcaactcaccttcccaccaatcgtctgtgctattcgttttttgcacgacgcgaatgcggtccccttctcggaaactcaggtcaccgtttccttgaccatcaaaatcgtacagcgccgtgacaaacactggacgggaagctgccggcggtggtggtgggggctttttcttccctatggcggcagtcaagggcgataccttggcttggaaagagtctatgtttggaccggcgggtgatctcaccactcctgatgaaatgggagtggcttgtggagtcggcatgaatgccggacgaggggggtcgaagtagtcgccgcccgtcgagaggggctgagatcctgcggcgtttccaacaggaattgcgctgctcttgcgattaattgttgacaggggtggagatggagggtattctgatacgcagggtgtctggctcgacgatcctggagtttgcgatccccggcggaaagaacctgggagtgagaccgacgaggcagtgctgggaacgcggctcccatttgatggacgtttcttgttatcttggtcggtggcggctcgacgcatggccttgccttgggtcagggaaccgaagctttctatttcggcttgcacgggtttgaaggcaaactcccagtcttggacaacttgttccatggctggtggcggggagggaaatccttcttcttcacaataagtatgaagcactgtataatagtgcgcaagcatgcggttttggatctcgacctgtgcttcgagaatgtatggtgtcagggagaatatgagagcgaccaatgttgggagtcgctgtcgtagatcatgatcagcagcttggtaggcctggatggcgattagttttcttgaaatcatatgagtaacgttgggcgttgggatttgtacctctttcgtattggcaagttctgcctccgctttggctaggctcacattttcgcgatcactgcgctttggctttttcatgaggctatcaacacgcccttgggagatttcaaagtcggtctaggaattggaatattagcgacaaccaatccaccaaagactctcatttttcattgtgtaccttcttgtcatttcgctttttgatcgtctttttcatcggcgcaagtgattccttggcccgcgcagccggctgggacatgcgagtatcgacggcaccgagttcctccaagagatcggtacgtagctcatcgtattccttccgcagtcggtttgtccgcgctaatctgacggggtctgtatccacggctttgtggttggagggggtttctgaggagccaatgataggaccgtagaggccgtcgaactcctcgacaaggcgactctggtaagttgcgatagagatccaagcatcacgccaggcttgggtggattccacgatctgatcaaataacacgtattaggaaatgcgacaggacgcgcgtcatcggggtaagattaccttgcccaagagcatatctgcatcgtcgaaatcttttagaagcacagcaatttggctatcatctgcagacgacttcgtcgtcatgcgaccaaagcgcctcgacatgttctgcatattgggcgatggggagctctcagaagggaaacacgaaacagggagagaggggtgataatagaggtatcgcacacggcagagtacttgaaacaaccttggaataacactttaattcgaatattaatcaattccagattcaaaatgtgaattgattgggaaggagcattgaaagaaaccttccaaggttggaaggaaaacgtcccatcccctcatgacacataactcgcccgcgggcggccccagtgtttcagcctttcatgcggctctcgcgtcacggcccctccataggtattgacgtttcgggaaggagatatgtcaatcagctttaaccccttctccactctagatatgtacatcatattgaacaaaccagaggtaatattagtagtagtcttatcccatgcatcaatacggtatacctatagcaagggtatacatatcaagtgtagctttcatagaattgcaatgaaagaaaagctaaaataggtaatatgtaaacattgaaattgataatgaaattcacggtatccatggaccaacgaacttaacctgctcatgtacggactctatttgactagggacctcgatctgaatcctcgccgtgcaattcttgctcgcaaaggttctattacttgtagatatttgttttgcgtttcccttcgatcataaccctccagccatccccaggtaaagaataagctttatacaacatatcatccatgcaggaggaccccctattcgaaatactaaacaataccgtagtcctatagtatttctaccgtatttcaaaattatactgtaacactaccatagtttagatgaataccgtagtttaactgtgagatcaccgtattgaatttaatactatattccgatttaaatacctttaatactagagttctatagtaaatatacagtgactggtcttgaatttttaacacgttagccccacctgggcacaaccccttaattatataatatactgccaatctacctaggtaaaacctccataaattcataccatgaaatctagtatagtgtatacataccacccctggctctcaatgatagcttccacccggtgcgacatcgtctcaaagagatgctctagatgccatagctccaattcatcccatgccaattacgatatcgctaccaatatctccttcgtcgtgtcattgttatccatattttagcgtggttttcatctacgcgttttgagcaggcggtatattcatataccggcggtgaactaggtggggctacaggtgtgttaaaaacatatgactactgaccttagttacctacgtaatatagacatacgccttagaatacggggtaatcacgtgatattacgtgatccgcttagctaaccttggaaaagcaaccttggaaccttccaaggttggaacctttactcgttacagataaatacgtattcagaaacaggggtagtattcactatatatttagccaatctttagtattacatagtatttaaaagcatttcttcgcaaaagtagtattctatagtattagcaggcaaatacagtatttaagtaaataccgtattcgataaacttcggttattagtgtaaagtttttgaaataccatatttattcaactaccgtagtactaccgtagttctaccgtattttaaacccctctgtctcctggatggtacctatttgttgtctgtcccggttcaagtcagaacgggtagccttatcattaagccgcacaacacgagaacaacatgactacatctacatttcccgactccatgcgatgcagccacgatcaacttaggtgtcccacaatcctacaatgatgtccacgccgtcatcttccgcgcgtcttcccccaatcttcccgcaggtcattgcgtcagtggtgaagtttcgctgcctatacactcatgacctacgccgcaagtccaaacgatggcacgatggttatctacgttttcataaattcaataaacgtgtcatggtctacgatgaccaagggaattttatcggcgaccaccactggcgatctcccgatgatgtacaagatggcgacgaaatggagctggacaaaggagtcctgatcgaggtgaccgagaacatgggcacgactgagacggacattacaaccatatacgaaaagaagaaatccagccagggttcgccacaggccagagacctggtgtcccaagtcccccgcacctccacctcagtctctgcctcagcacctcttctttcctcccagtcatttcgctcacttaacgacttgctgggcatcaaaaggaccccagttggccatttgatgtctccatatgagcaaaggaatcccccacagccaacctccagcccccaggagcctgaacgagcgccgaagcggcaaaggacggcctcggtgatgaatcactcgcgtgcccagggtgaggtcgttgatttgaccgattcaacggattcacctcagggaccctccatgaggcaaaggtcaaatcaagtcacgaaagaaccacccagagccgggggtgattctgcggctgatgtactcctaccaaattgtgagcagaggtcagcaaggcccctggccaataaatccaaagatggaccgccgcatattcagccaccaagaccctccgtcccctcgaccgattttcttcccgctgtaacctcaaaaacagaaatacccaggcctcgaggaaacttgcgcgtggagcagccatcaatgaaccgtgagaaccagtcaagagctatttcacgtcccatcccactacaaaagtctgatcctccgacggtttcaagaagctctttcccaattgcacccaagcggtcctctgctgatggatctgcgccacaggcgccagtgcgtgcagtcaacaattatgtaaaacctatcgagcccgcggacaacgaggcttcaaccaatattccacctccagtcaatgttccacctacagccaacgcaccgccttcaacgaacataccaaccccatcgcgtccatcttctgcacttaactctggtgcacctacggcagttctacgcatgggaaccgcaaagccacgcagaaagctaatgtacagtgctttactgcccggtgcttcacggactccatcgccggcggcctcagatacaccgcctggtagtgcaacgcgtggaaccgtcacaaataccccggagcaacagttagtatgtacgcacccgttaaccaaggtcgcgatactgatttctgcgcaggctgaccgccgctccagataattccgcaaatgaagaatttgtgccttcgacctcaacacaatttgtcttcgacgaaatgacagatggatcagggttcaaatcgccctccacaatcaaaaggttgactgggaaaagatctctcgattcgccactgcgtaaatcgatatcggatccgactgccttgacggcccgccaggccccggcagaagggtcacccaatgcagccaacaaggaaaacgagcccaaagagcaaggcccctggacatccgaggcattagacttgtttgatttctggcctgctggacggccaaagccaaacgagtgaaatacaatggtcggtctgggagtcgtgcatgagtttttaaggaacaatgagcagggtttaaaccaacctgatgacgcaaaggacaagctcctttcaaggctcttgtgtccagtgatgtccactgtctcgtgagaagcagccaccaaatcgccgaaaaccgttgtcgaccgtgctgttctcgaagccaaaccagtgagcagctttctggggtgtgcctgcgagagaaatactattttccaaggtgtatgcacttatgaatgtgcactttgcgagaaagtactcctgctgtggaaacctacgcattcgtactacagctccatccgcctctctccaccgaagccgtcaaacccctatctacggtggatttaacgggcttgctccatgaagtttatgctgtgtctgtttgtccgaaaccaaacatcaagacccagaatcatccctaacgacctcattgatgcgagtgaaaccgtgatagaaacagagctaaccatttgacattgctacaaaaaaaaacttgtacctagctcagctcaaaaatgaatctgaaacctaaactcctttcttaaccaaaaccccagaaatataaggcataaccgaccactcgaaattcctctccaactcaaccctctcccacccaccatccacatcagccacagccctcaaaactgcctcagtatccctattcaagcaacaatccccaataaaccaactccacccaagaacatgatacaacccctgcacaacccgcccaacaagcgaccccttagcccgccgccacgggttaacaacatgctccgtgacaagcaaccgcccaccaggcctaagcatcccatacagctcccccaccgtacgctccatctccggtacggaacacagcacccgcacgcacaggatcgtatcaaagatgcccgcgcgcggatcggtatcatacgcgtccacgacgcccgtgcctgtggcccgcaatgcggggaccagttcatcggctgctacgcctgttggcacgatgtggtacttgggtgagatgttctctgcttgcgcttttgcgcggagagatgcgtgtaggcccttgcatggctcggcgccatatagggctgttattgctggtgaggtgagtagtggcatctgtgtgcctgtgcctggaccgatgtcgaggactatccctgaggctgtgcggaggattggggggattagagctgaggatccgactggctcgggggtttctttgttgtttgggtcagagctcatttggcgcggtgctgtggtggcttggttaggatatgtgtgtttatttgtatacagattgcttcgtttatgttggtagggcgttcttttgctttcccagttctttggcttgtgcttgcaaagagcaagagttcccctctgggtttgttggtgatagatatggtggctgggactcactgctgaattcgatccagaatcttccgaatgcttcatcgcggagtcttcgcgtctgggtaattggggcaaagacctggccattcttgaagactgcttcggcgcagactcggacgtagtctgtagtattggagttagtaatgtgctagtccatggccttgaaaacgagaaatctgtgatggtgcgtcaggaatgtgcaacgatatatcaggatacagttagtcccaccaaaaggcagaagaagatgatacgaaaatggatacagaatagggcaactacacaagcatatcgaaagcacatccatggtagagcaaaatcaggcacagaaaaagcacatccacccgcgtcgaattacatatattcaaatccaagccattcggtgtttgttcggcgtctgtacttacgcgacatggcccaagtcaagagatatgctggctctaacattccgagcatacgcccggtgaaaggtggggggctttcgttcgacattatggttagaaaatgttcaaattcgggtttaacaagcctcaatgcatactgggaggagaaaatgcaagaggaggtttatatagtgagggcacggatatctctcacgtgacacagactttgcggggacttcggcgttcgaaataagcaaatcacatctccagggctgcagctgatctgaagaccagtgaaggacaaggggatgattcttcgaatggatgactatattgtctcatctggcattacgaaatcagaattaatcaggcataatccaacaaaattgaacacagactaatatctagcatcctggtctggtgcaaattgcacaaatactcaaaagatggtcacaccggaacaaatagtggagccaatcagtacaaagacgatggcatcaagtggtaacagaaattatcaacataaaaggagaatataggaaaagagcagactcagattgggagaaacgttccagcaggacgcaatgattgaacgaaggtcagagacagtaggagagttgagatctgtagagagtaaagaaagaaaaagatcgtaggtgaagagaaggcgtgtgaagttgggggtgaaactatccagggagtttcggagcccaagaatccagagtcaccaaatagtacgtaattcagttgagtctcggtcctgagatttgaggtattccaactcgtatgaagggaggtaagttggaaacgctattaaaaggtttgctggttggacaagagacagaagaaaaggagactcgtcatcatctttagaagtgactcgagtctgggtcgaggacctgcccacaaaccctacgaacaaatgcccatctcgttggacgatgttcagtgacggtggggtgagtggatgcggttgaccctcggactgtaccgactggtgcgagaaagtgagccaacatcatgttttccgtcgcaacaggcgcggacattctcgagccggtcttgttcctgagtttcgatcacctgtctcagatcatcggcactttcttggccatgcaggctttcgttgtgaacactaggagtctgaccgtgccggcccttcaagcttgcgatggatccccgaatggaactggagatggtgctgagtcttgacgaagaacgttggcgctcgtcgggaacttgcagagacgagtttggaacgggtgaactgagcgccggtgatgcacgccctccgagagtcccggaagatcgcattgacatcgccgaggccgctcgccgctgttgcttggctgcttgacgagcggtgcggctattgtaagatgagaacgacatccgtgctgtctggcgagaaccagaccggaaaccagggggattgaattcattgatatcgtcaagggttacgctgttattgtcctcgcagttgtcattggtctcccttaaaaggaggtaagacaatgcgttgaaccatgtctcgtgcctctggctcgtcgtagccgtaaagcgaactcgtcggccaggactgacaacctccaagctcctgcagtgaagacctggaggatacgggttgtcatccgcaaccactcgaacagcctcaataggcacactcttggtgcggagctcgctctttccggcagtttgagggtcctgcgtgctccagtacaaagtacgggtgtacgggtgaacccagaagtatcgtcggtgccgcgttgtggacatatccgctgagccggtcttccgagtgtacttccaaaggaattcaccgatcatggtttgagtgatcgcctggatcatacgcggatccgtattgggtccatagccatggggcatggggccagcgtgaggggccatgttgaagcgctcctcgagctcagacgcaaaagatgacaccgaggatcgtcgagacatctggctttggcttcctctcctcattctagcctgagatgaaccggttcttgaagagctagcccgcgcagcatgttcgcctggagtaagtgggcgctgggaattcatgcgataggcggaggcaggtgccaaaggaggccccatgacagaggtaggagatggcggaggcatgtcgatcggcttcttctcggctgccatgatagcttcccggtgatcgacgggcagtggggggtgactaacacctgatgtctgactggcggcactgtgaggccggcggtgtgttggcgttgtcgatttcgcagactgaacttgcgaaagacgaggtcgcgtaggagctttgggtgtcacgtaagctgacgcggcagctgtagtgactgcagcaatctcccgtgagttgtctgttacctggctgtcagatgatagcgggcgtgaggacacacgatccataaggatttgatctatctgtttagaggataggatagtctgggacccttggtccatgctcactgaaatagattgctgtctaccagagcgggcaagggcgttcccagagatatcgttcaaggccagtccggcaccagcgggctggtcactattggcagtgctagtgtggctacgagtagcgccagtaggctggtcttcgcgaacaacgacagcggcacccgcgggcttgggctctgttgactcagtctgagtggataaatctgccgccgcagggataacaactggcttagacttcactggatgagtttccacagagcgaacagaggagaatgacaatgccggtgtaggggcaaggcggggccttgggataataggctccgtgtatgctggattgagggaagagattgtcaaattcggtacctcacgctcacgttcaacgtgcttgattacatccacgtattggacgacaggtggcaccggttcaggaacggttgctttgacggggctagtggatttggcggcgatcgaagagaaggtcaattcgggcacctcacgctcacgctcaacgtgtttaatcacgtcgacgtactcgatgataggcactggtttggtgacagtcgggtgtgcaggggtagtggactggttgttgatgggagagaacgttaactcgggcacctcacgctcgcgctcgacgtgcttgataacgtcgacgtattcgataaccggctccgctttagcaagacttgcatgtacaggcgcagtagattgagtagcgatagaagagaagcttgactctggcacttcacgctcacgttcaacgtgcttgattacatccacgtattggatgacaggtggctccggttctggaacagttgctttgaccggctcggtggtttgagtagtgatggaagagaaggtcaattcggggacctcgggttcgcgttcaacgtgcttgatcacatcgacgtacttgacaataggctccggcacagcaagagttgcctggacagggacagtggagtggttattgatggaagataatgtcaactcggggatctcgcgctcacgctcgacgtgtttgattacgtcgacgtatttgatgacaggttctggctcaggaacagttgcctggattgcctggacaggtactgtcgactgagcggcgacagacgagaaactcaactccggcacttcaggctcacgttcaacgtgcttgatcacatcgacgtacttgatgataggctctggcacggcaagtgttgcatggacaggggaagttgattgagtggtgatggaggagaaggtcagctcgggcacctccggctcgcgttccacgtatttgatgacatcgacatgcttgatgattggctcaggtacgagaaccgttggttgaacgggattagtgttttgggatgaaactgaagatatcgtcatttccggtacttccggcgggggtagttgatgcttcacaggcgtagtggttcccgcagtaatgtacgagacactgagatcgggtcgcttaggtgcagagggcgtggtctcttgagaggaaacgttagccatgcccagctcgggtaggtcaggttcagcgtggacattgccctgttggtcttccaccgaacgcttttccgtttcctcggcgatctcacggtctgctgtttgagctgcgtggggtgcagcgagagcatgcggcaggacagctcccgcagcaagaccggcagctcccgcaacaatgccagcaccgatagaatgtgtaggctcccaaggttcagtcataacaccagaatccaccattgtgggcgtggagggtacatccagcattgcatccgagggtcttcgtgaacccgatgcaggctccatgcgcggtgtcgaagcctgggaggtgacttcatcatcctcggtgctgtcgagctctgcaagttcagcaaagaggctctggccctcttgagctgctggcgcgggcgcaaaactgggtgctgcggactcgcgtgaactcgaaggtcgactggtggacgcgaatgtagcctctccagatggacgaatgcgtctcgacatgctgcgtttggacttcacacggggtcgggagatattcatttggctaggagagccgaacgctctatcgaattcttcgtcatcggaagatgcggaagcagtgctgttatatgaggcgcgatcgcgagctttggccataaccagggaagaaggcacacggcggacaggggttctctgtaggttattttccgtctcggtaagatctgccgaatcgctgctgtcatccgccatgctttcgacaccagtctggaatgcttcgctctcagttgcggttgcccgctcattcgccgtttcaaatccatcttccgcctcggtagctgtttggtagacatcgctaggtccatcggaagactcggagcgagggcggtccctagaggatatcgccttggtgtgggtctgggtaggactgatttggccggcattgtcttcccaatcggtgtcgtgaagctcaacaaatgatttctctttgcgtcctgcgcccagaagatccgggcgaggtggctttcgagacgaatctgtcttgttcttctggcgtttgctagttccgtttggcgcagtgctatcacgacggcgttgctcaacttcatcccgagcatcttgtagcatacgcttgagctcaatcttttcggtcttctcacggtgaattgtgctcttaaggttctggatcatgcgatgagcatgaccgagcgagctcttcaaagtctccgattcaagatggccatgtcgaggagtgaacttgttgggggatggcggaggagagctctcaggtgtgatatgctccggctcgtggccctcgctgtcatatggaacatccctagtgccttgatgttcatgctctcggagcctcatggcaactgccttggcgagttcttgattttgagaggtcatttccatcagcttcttttgaagagcggccttttcagcatcgccagaagtcagattccgccgcaataggtggatttccgcgtcattcgccttctgagtgaggctctgatcttcaagtaacctagcattggtttgcctgagctcctccagctctcgttccatggcgttcttttccgaatttgtcgatgttatagtgctgttgagccgttgttcacgttccgcggcctccctcgcagctgccattaagtcatgtgcttgagtctctagcgcccagttctcgtccttgtatcgttgctcactgtcgtcaagcgcccggattctctgtgcatacccctctgcctccaactcaagtcgcgatttttccaagttaacaaacttgagtgtctcatcccgttctgcgagaagagcttgcagttgccggacctgggccaaaagtgaagtggagatctcagtcgcaaattcgatatcgtggacacggttggatggttggttgcgctgctttcgggatggaacgctgactttgcttggggaatttgtagcttgactggcgaacaaagcgggacttaagggtgactatcagatctcgacgttagttcggctagaaatcggaccagagtcagatgtaagacccaggcagtaccttttgatcgaaagatggcgtcccaagctgagcatcctccgggcccccggcaaggcgtttgggtcccagaaacgcccgtgcggactcacgaccgatctcgttgtactccttctccaaatccgcaagtttgcgtcgcagttccgggcccatctctccctcattctgctcctgttcgacctccttcaactgctctgatagctgccgctgctggtcgataagggccgttcccagcttcgatgcctcctccagtcgacgctctgtctccgccaagtgggcctcgagggcccgtttggcctgtgctggcgaagatgcatttaggctgtatagctgtgtgtcgaaggaggagaatcgattggagtcgccaggcacagctggccttccggaattcgcaacgaaggggtcttccatcgatgcaaatgacccggtggcctcagcattggatgcggtcattatttgggaatcgtgggcctcaaacggcatctgaaccctcttagtgacgaggacacagttgccgttgagatatcggggactcgcggcttgatctttgttgtgattctaggccgcgggcatcatccgaattaccgcgctcggtgaaaggctgttgtcgcaagatgattcccgtcgggatctttgccgagccgaccagcgacaagagttgttcgacgttttttttttttcgagattaccgcacgctaatattgatgcgatgggcgttgaacggcacaccgttcaaagatgtggaagggaagaggggggaaatcccacacgattaaaaacaacaaacaccgaggaccttcggacgaatcagtgagctcccggtaagattggccagacacgcgcgaagagatgcaactaaccacaacaaagtgctcgggatctgcagggcctttggaatcggccttgttggtctgaataaaggaaagactaaaagacaaaaggaaaacaaaaggacagctaactcaaaaaagaaaggaaagtagaaaaaaaggaaagaaagggagcgtagggagtgattggataggtcgagtttggatgactcggcgggggaagaagagggaagagaataacgagagtgagcgaacgtggtgttgttattgccaaatggcgccggtgtttgagattcacgatcgataattaccccagacggtgagacgaatctacgatactaggctatattctttgttctgggtacctctaaatttactataaaactgtagaaacaatatgaaatgctgattcgacaggttcctgcgtgttctgctgcgattttcgctatcaaacgcgtcccaaagtgaggaggttgtttgtcctgtttgcccggcccgcgggcattagatctgcttagtcatttctcgatggccgtttcgatatccaacgatatgcgtgcgtctttacaacctttccatctgacacaactgcttaaacatctacgactaatattcaccgtatccaacatacaatatgggtgaagaaactgaagttgcaggctctgttccccaagtcgccttcaagaagcgctccaaaggcaaagccaactttcgcaagaagcccgcgacgccacctcctgcatctgactccgactccgactttgtatcatccgatgacgaagaaggccgacggatcaagagacggcgcaagaatgcagctgtcaccgcatcatccacatcaaatgcgacaaggaaacagcgtgcagaagacgaacctacaaccgcggttcccgctccattgacctcgagcaacgatgccacaaaggcctccgactggtatgatgagaacctaagcgagaagaatttgttgggcaaaacccgggaaaacccagtctctgcctcacagccggacggaacctacaagggcgccgccaactatcaatctttcatccagaagaaccctaatgcaccagggaaattcggtcctgtcaaagctgcgaccaacgtcaggactatcaccgtgacagattttgcccccgatgtgtgcaaagattggaaacaaactggctacgtgagttacgctgtcgcctccatctgtctattgtgaatcgagactaacctatctataattagtgtggctttggagacagttgtaaatatctccattctcgagaggcatacaaggcaggatgggaactggatcgtgactgggaaatcaacaccaagggcaagcaattaagtgggcgagtggtttcacagcgaaagggcgtgggcaaactcgccgaggaagacgatgatgaggaggaggatgagttgctagagagcatcccgttcgcttgtctcatctgcttgaagccctataaagaacctatcgtcaccaagtgcgggcactatttctgtgaggcctgtgccctacagcggtaccggaaaactccatcgtgtgctgcctgtggcgagggtactgggggtgtcttcaacgtcgcaaagaagttgaatactttgttgaacaagaagcgggaacgtgcacgcaaaattcgagaggaggcgattgcaaatggggaggaggtcagcgatgaagaagagggtgatgatagttgattagccggggaagatctctctgtagcataatataacaggcagctggactgcaacacttgtcctctgacaatgtatcaaaacttgtttattttatgtcgatttatctccattggcgtaccgtgaaattgatcacttaacaatgctttgaacatgagacgggaacgcgtaacatgcaaatcagccgcgtgttctttccggcctagtatgattttacaagggtaggcgccgaggcactctatagtctacttggggtacgtgtggcacgctagaccattcaccgcattaagccatgtatacttcatcctgttctgttcaagtactccgtttcccacggagtacgagtacaacgtacaacaatacgctagtccaacaagcgaagaggcaaccctgagatcaccgagatcttcactgatccagtgaagatcagacgagccaagaaataatatcgacgaccacacggcatacaaacattcagtgcagtcgatattccattgcgacgcaactccaacaacatacatgtacagggagcaacgaggcttcttaaggttgctgaatgacacaacaatcaaaatgcgcctgggccttctgaaaaatggctcgcttgaatgcctctgatgtcagaaacgtcattacaagacatccaacatattgcagtgccgctgatcggccaatatgtgggcctgatgtctgttacagccacacgctgcaatcgaaaaaaaaacccacatgctaggaccctggatctttcaagagtccgttcgccgatgaaaatcataccaagggatgccaactgtccagttcgctgtccgagtatgtaggctgtgcatggaaaagggatcatcggagccgaccagtaaaggcaaggaataatccgaacaattttaaacccatttcaaccaagcgagacagccccactgggatacgagcataccgaataatagtcttgtggaggacttcatactattcccattgcggcgttcagtattccaattctggaaagctttttaatttggcagtctcaagcccgacgccacgtgcattccgtggtacgggaaaaacacgcgtgtcgccacagtggattccaatacctacaacataggtaactttgcgatagtctagttaggttaaatactgttgcctcaggtacaacgttttaacggattgtccatttacaaggtttaaactcttaagccttgatcccgtccagaggggtccatccatggctcaagcgtaaactctatggtcaaaaggggtaaagcgtgcgccatagccaagcttttgcttttcccccaaccacaaccaaaaacccaaacgccccttggcatcaaactaaagggcggctcccctgaacgccccagtggccaatgatatgtccatgacattgttaaggagtccactcgaaagctcccctctttctattttactttaatattcccaggtttccactttctactccgtacggggtacaattcttccttttaatctgtccccctttctactttccgtgtcctttattacctcgactacgccttccttctatatcatcttgccttctgactcgccttcaggcgtcttggtactttgaaatcacttgtcctatctcgcatcgctatcatacatcggaaaccgtatatatcaatggcttattagttaaatcatcaacctcgacttaacacctacgggctcctctccgcagagtccccggggtattatccctctcatccatcattcataatgagaggcggtctccgtatagcagggttttccgtctcatgtctcgtcctattctcactatatctactcgaggcgcatctacaagacatctgcaatcaatatcgcgctggcgcatacgtgattaattggctagatcgcaatgacaccgcctcgactccacatggcgagacaacacctggtgataaggtgattgtcatggccaagctagaagaagagaataccgaatgggtggaagaagagcttcccgagtgagtgcttttgatctccaaccctccactgaagaagcacggctaattggctttctttctctccaaacagctggcaacgggcaatctacaccgtcaacccctcacacgagacacgactaaatcccaatgttcttacgaccccattcaacaaaggccacgaagccatggcctacttcacgtatataatcgagttctacaacaatcttccctcgaccgtcgcctttctccacgcccaccgcgcaggctttctcatggcctggcacgtggacgcgccactccacgacaacgtcatagccatgcgcaacctacaactcgatttcgtccagcagaacggttatgtgaatcttcgctgcaattggaatccgggctgcaagggcgtccaccgcttcaatggccatgtcaccgagccggtctggatggaagtcttcgacggcacgagtacgcctccgttgaatgcctcctcaaccacggatcaggagttcccgggccagaaatatctccgcaagcctgccgagattggcgccgcatgctgcgcgcaattcgctgtctcacgagagcagattcagaagcgcccgctggaggattatatccggttccgccaatgggttatcgatacggagcttagcgatgcttcgtcggggagggtgatggagttcttgtggcatgtcatttttggcatggaaggggtatagtaagttatgatcgatcacgtttcgctgtaatgttgacctaaccgttttcgcagttgtcccgatgaacaaatatgttattgtcgagtctacgggcagtgttaaatgcgctctcggcttgagcattcgttcccaaatccagcgacacctcccaacctggtatctacatatcgtgggactcgtggcgttacatccttgcctccaccttttcgtcatgatgtgcatgatttttgcgacacaacacaaacaccggcccactcggaattcaggcacccctttttgtcggatagaacttggagttttcaggggccctactttcttcatagattaattgcgttcaagcgccgaggacaaagttcctcatgcacatactccatcactttcgttgatggatttctggataatcagagtacatgaaatgtatattcttaccattgtctttctcacttcctatgcacacatacatgtaccataccattcagatttctacatgtgacctccactatcaatagtggctccatgctctgataccccccaggtggccaaagcatcttatcattcacgctttgtattttatcagactttaatcaatagttaccaagacaggcgctaaatttccagagaccgtccaaatgtactgcttcagatacccattcaccctgtgacatcaccaggacaagcagtcaagtcaacgtacccatcaggcccggctcccgctaatgcgccctgtgagcttgtgtggcgattcagatgtggaagcgctcgtggatgcattgagtgatgcttgcattgggaccaacccttcatcccagtcgacatcctgatgcaggttctgccaaggccggagccagatttcggcggtttggttcgaacgggagtctgtactcaggtcttgaggaccaaccttccaggttccgcttcggctgcttgctcttgtagtgtgctaaggtacctctcgaggagatcttttcgtggcacaacacgtacgttcccagcccctaagatgttagggagtctctcgccatctagtactgcccgacggccacctaggttaccatgaaggtatccacggtattttgtgacgagggcccacgggtcttcgcatatcagccatatttggttaggcgctagttatactcataaaattagcagagagcggacaagacaataggacgaggaaacacccacgtcgtggaaattgcggggataagaggtagtggtacaggtaggagtcttgacgcaaaccacccatccccaccagagctgtctaggtcgtctttgtctgtaatgcccaggagggctatatgcgatgccgggggaaggtcggggggcagggtatcagggactcaacagactaagaagggagagaagatctaagatttaaatagatatctaaaaaggactatataaagacatttgggaaccactgaaaagaccactgaaaagtccactgaaaagacctatgaaaagacctatgaaaagacccatgtatgaagtgactatcggagaaggctatctaggaagactaggccaaccttggaagggtgatctctttttctacccctgtagttgctagaggtattttctggcattttgcataaagaagtatcggtgatatatatcagggcgttcacgccttttaccggcttgcgcctttgtatacatctgaaaagacatcgaaaaagaaacgccggtatattcttatatataatgtccctaacatcatcctggataaaagatatcgattcatttgaaatgactatgaccttatggaaacaggcaagtaggatacactcataactcattaaacgggccgcagattacagcaaccttggaccaccccaagacgatcctgagcaaacttcaaatcaatgtttaaaacttctgctcaaagtactgctcaactcggtccacgagatctgctttctttcctgctgtagcacggccatgtgcatgcaagaattccttcagcacggccaccgtaagctgaaggcgagtattagtttggtcaatcacctgggagaatttgaatgctcaccttggaaacagtgcctttcgcatagcatttcttcacttcgtcttccactccgggctcactgtcttcaaccttcacccgctttgatgggtgctcaccagctgcctcggtcttggcacctcgctttaccagcgtagaggtggcggctactgacccaccaaacatctcggaggcttgcaatttcagttcctcggcccatctaagaatatagtcgccagcgcgctagaacatccatttggtcagtacgttcgggcatttctgggatcatggaagcagccaaccttgtgaacctgtcggtacttaggcacggtcttgtcatctggtgattctgggaaatcttcatccaaggcgatagcctgtaagatacgataatgccattgaagcgctgcgaatcagtcagtatcattgtcccaaagattgaagtgacgaaggctcacaaggattcggatattttgaaggatcgtacacagccttggggagctgcaactggcgaacaacatctcgcatggcgtcgttcagcgcatctcctgcccggtggacggtgctctctggattttggcgcacatcatctgcgaaaggaagagggataatccacatcccaggtggaattttctgcacgccattctcgtcgatcttctcagcacctgcaatcatagcagctaagactggtgaggcatttctgcgggggatgaaccagaccaaagccagtttctccgattcgaggagtttctgatgcagtgcagaaaagactcttgttgaaccgacgtagtcctcttcagagggataaataaacgaggggtgcttgacattggcccagaacgggagggctgacagtggcttgaacccaataatacggatcaccgggtcaccgaagcttcttagcgcctgttgttcttcgatggtgaatgatacctgctcgccaccaaacttgtatgccttgcgaatgtcagacttctcaatctcctgccctgtgtcatcagacattagagttgtgactcctttggcaatctgagcagtctcgcctccttgccagacgaagcaactccttgcaggctcttgtttcttgagaagcaaatatccattgacggatattttgaaattaggtccgatctcaagtggcacatttgagaacagcgatcggcgggggacagatcgtgagttgatgctcgacaacagagaattgagcaatgaaagtccatcgcctttagctgttgatgtgttggtatccggctgtaggtatgcaggggcatctccatcactgggcgatgttttgtagataatgtcctgccaattgtgagtatacccctatgcaatcaaggttaatgacctacgtcgtagaatttagaggtgtcgaattcgtggtctggttgagatatgggaaacaactcgatattgacaccaagatcgtacaagtccctcgcacgaactgttgcagcagaccgcattcctttgttgtctgcgtggggattatcgttgtcggtcacgacaaacaggcgtcgagaagcaaagtttggagcttttgaggtaaagatttggttggcgcagaaaagcatgttggccatggaggctggctcctttgatggctccaaaacttgcagtacgtcatcatcagcatctgctggagatgcgagggaccgcagttgcttgacttcctgggctgatggaacatcaagatccgtgtacagataacagtgaggatatgagagatctccacggtcatcctcattttcatcatagaacttggaagattgcgttccgtaaagcaaaacgccaatcatgtcatgagggttggagatgatgcgttgttgcatcagatggtatgcacacttcaaagctgcagacgcgggtgattcgtctccatgtttcttaggatcaggcgatggacgaggcgtgagcatcgaactgctaatatctatagcaaacagcaccgcatctttgactgatttgaagctctatgtaggcaaccgtcaacaatcggtaactatatctccaacttttgatactcacggtctcgtcgagctcttcatcctcgtaattctcctcctcgcgcgtgtagctatcttcaaccattgttacgaagtaggtatcctcgggagattggaaatattaaaaggtgtaaattaatcaagtctaaagtatcattgagacgcgctcgttgacgcgggcaacacgaaggtcaggtgacgctgatgcctgaagctgctgacatcttcctgcgttgattggtccaaatccggtggtcggaagctatatggggcaagcaggaccggattcaacaactccgaggtccaagttggaagttggaagtcggaattgtcatctcttcattaatatatcagcattatttttgctctactcctcgatataatatcttggcctcttcgaaccatgacattccgcagccctttcgcgatcccccgacagctattgactgggaccacatctcttggaggtcggtcggcaattagcactcgattgagatgcaatcaacgaggtctcgcgacggtagtaccgccagtcacacaagatgcgacgggctctaagggtcccacggctatggtttttatgaacatgggtggaccttccacaacggacgaggtggaggactttttgagcagactatttgtacgcatcataaattgttcaaatcgcggctttgaatcgatatgttaacacattgaactacaggcagacggtgatttgattccccttggacgactccaatcgtatctcgggcccctcatcgcacgccggagaacctcgaagatccaaaagcagtacgcggatatcggcggcgggtcgcccattcggaaatggtccgagtatcaatgcgcagaaatgtgcaagctgttggataagatgtccccggagaccgcgccgcataagccttacgttgccttccgctacgctgccccattgaccgagaccatgtatgagcagcttttcgccgatggattcggcaagggcaagggaggacgtgctgtcgcatttacacaatacccgcagtactcttgttcaacgaccggcagttccctgaacgaactgtggaagtggcgtaatcgtctcgagggaaagcgcgcaaatggaggatccgagccggctggcacaatccaatggagcgtcattgaccgttggccctcccactctggtcttgtggaggcgttcgcacaaaatatcgaggctcagcttaagacctacccagaggagaagcgagacgaggttgtgttgctgttttcggcccatagcttgcctatgagcgttgtgaaccgaggtaggctgatgtcccctgattacttgctagaattacactaattactctcccacacaggcgacccttaccccgcggaagtcgcagcgacagttcacgccgtaatgcaacgactcaggttcaaaaacccttaccgcctgtgctggcaatctcaagtgggacctagtgcgtggctcggggcccagaccagtgatactgttcaagagtatgtgaaaagaggacagacggacttgattctagtgcccattgcgtttacaagtgaccacattgagacactctacgagctggatcaggaagttatccatgaagccaacaacccgggtgtcaagcgcgcagagagcttgaacggaaacccagtcttcattcaggcacttgccgatattgctcatgaccatttgcagaagggagaattgtgttctcgccaaatgacactgcgctgccagggctgcaccagcgagcggtgcttgggtcaaaagaaattctttgcaggccaggaacaagcttccatggtgatataagctgagtgggcttgagcttttccttttcggaccaagagagttcatccttgggtgtttgtatatggcacttgtaggtgttggaggcgttagagtataaaatttgggattagtgtacggtataatatgttttcaattctatacaagttggcaaggcatccacgatatatacgaaagggcaggccgtcagaatgacaccccagtttaaccgcggcacctcctgggaaagcacttaagtccgtgcggagattccggagctatcgattaccaatgatgaaatcccgataagaattcaaggaatcctaaacacttaacattctcccctctttcatatggggatgaattgtctgtggtttcagatcttatatatcaacatttgaattatacgataaccttggataatcctggaatcacctccaatgcctccaatttcatgatggagaacgaagaactacttgcgggggatcccgatgttgcccagctgcacacccgagagactcgcacaggagatgtgaatgaaaacacgcctctaattgatgaagccgatagcctgttgcatcaacagcctgtttatgttacggatagtcggccgaaatggaggaaaccgagcgtgagtgactatggcttgcgacaacagcgtcaggaacaactttctaatctgcaaacatgatagatttggtggctgcttccgttcggtctcctctttaccctgggctttggtggaattgccgtgcccaagatcaacctgatcatgtcgctagtctgtcgagattatctcgccgaaaagaccaccaaagaccctggcttcacctatctccctgttatattcggcgaaaataacccccagtgccagataccacaagttcagtcgttggttgcccagttccagctctatctcaatcttattgccggtattatatcggcattagtgagtccccggttcggacacttatctgatcgttacggaagaaccaagatgatcgctctaggcgcgatgggcgcggtattcaatgaacttattactgtcatcgtggctcaatggccagagcggttctcagtcaatatgcttctggttggagcagtcatggatggactcggtgggtcatttacaaccgcacaggctttgatccattcctatgcttctgattgtacgccaaccgaaaagcgaagcgtggcattcggtttattccacggtgctctgttttttggaattgcagctggaccgggtggtgcagcctttttgatcaaacgtggaggcacgctactagtcttctacattgcgcttgcattccatgcaactttctgtctatcggtcttcttcatcgtgcctgaatccttgtccaaggatcgacagctcgcggctcgcgagaagcatcgcatgaaaattgtggatgctgactctcctaaatggtactcttggcgtgtctggaacccagtgaacctgatcaccccgcttgcaattctgatgcccgccgctggaaagccaagcgtcttgttccctaaccgccgcggtgccagtcaggctctacgccggaacatcattatgttggctgctatcgataccgctgtctttggagttgccctgggtacaatccaggttatcatcatctacgccgaatacatgttcaactggggcagcgtggagtccagtctgtttgtggcgaccattaatgtggtgcgagtggtcaatctcttcctggtgcttccgcttatctctcttttcttccgcaccccttgcgaggaagacggaaccattcgcggctcggacacgctggacattgttctaattcgcgcgtctataattttcgatatactgggctacgttggctatgctctgtccaaagcaccatcagtcatggtgatgtccggagtcgtcgcctcgctaggtggcatggggtctgcaatcctacagtcatctctgaccaagcatgtgcctcatgaacgcatcggacagatgctcggtgccactggtcttttacatgctcttgctcgagttgttgcacctactatctttaacttgatctacagtctgactgttgcaacgttgcctcagacagtgtttgtggcacttgcagctgtttttggtgtagcattcctcatgagtctgctaatcaagtcgcatggtatgtttagtcctgagatcctatgggcactatgctaattgttgtgccagttaccctagagagtggccgccctgccgatctaagagcggaagaagatgccgacgagcatgatggacttttgctttgatagacagctctgtgagataataaggttgcagcatatgttatatgcctgctttgctggcgtcttttctaatggaacgtgttctacatgattgaaatagactgttttttttttttttttttttttttttttcctactctagagagctcctatccgtacatatgtaggggtatctcgtgatgaagatgcttgatgcatgctaaaaacagaagactacctaggtatagagctattggacaaacaaatcatcgtgatggtcgtggaataactgtagaatatggtatgggcagctcgacttcctttgacttagacattgagcccctttccatgtatttcttctttcgagacaggtttgatttttgaaggttgaggacaggaagctgtggaggatgtatccggttagatccatggtcgtatgaccgagccaatctccggcgggcggcagcgtcctaatacgcaagttgatttgcatcgggaaaaaagaagttgctccgaacttaccctactctctcagcttcaattgcctgtacacttaatcttgtatcgtacctggtgattggagatatctacgtttcattgactgcacctagctgctcattttcggaacattggtgtgaggccgctcatgcacgactggtgaactcgcgcgcaacccgcgctcagcatccacaaatatgcttgcccgcgccgcaaaatccggctcaataatcccttctccaaatgccctccgagtgctccgccaattggctctggccggctcaacagtcggcggattctgcaccgtcgcagccctcacgtacgaagcccatcgccgagtccgcattgccgagaaaatcatcgagaacaaacgaaccttacacagcactgccccgaattatgacgcaacatctgctgccaaacgactcaaggtgatggttgaggcggcggaagcgggcgaatttatgggcattggatccctcaaggcgaggaatcggaacgggcctgacgagccagggttcgagacagaaaaggatgatccaaagcccaagcctaggcccctggtcagcttggaaaaacaccatgctcgctcaaaacgctcgctttttgggacccatccaattgcacaatccaactacacgggaaagatcgatgctccgagcttggctcagaacgctgaaattctggctcgcgagaaacagcagggcgagctcgcacaagaatctggcaagctaccctttgacgccgaaatccgcaggctgttgaatgaagagcgggaaatcactgctgcgaatttgttcttagcgcacactcgacagacacctaacatttcttgggaacgacgagagcttgcatgtgttatattcactgcaaactgcatcaagggaaaccttttcgttgctcgaactttgttcaaccgcctggataaagtcagtgtcgtctcagcggagatgtgggctacactgatgcatctgcttgcaaaggaaggccatatcgactctgtcggcgtcatatatgataaattcagcaccagctttgctgttccaacacatctgctggaggtcatcctccgatgtctgatcgagtcgaagaggttggactctgccaaattcctcttcttccaacgcttcgaggatgaccgtgactgtggtctgtgtggtgcttatctagatggattatggaggaaaactaggagcatggaattgctgtcatcccaattgggcctcatccttaaacgtctcgaatccctcggtcggcaaccaaccgagaaacttttcaatccaatggtcaaggccatggttgaaactgggcgagccgaagaagccgaagctatggtcaaggagatgtcaacacgttatggggccgagcctggatgccggaccattggcttgattatctacaaccgagcacttaattgtgaatgggacagggtcatggatggcatgcatgctatgcacgagcacggatacacccaatcaaagaaggacttcgctatgatttttgaccgcgtcttcttggaatactatcccacccacacaggcccgcaaattctcgacttcgtcatctcttgtatcaacgattttgacatacaacccgacaaagtactccaccgacacatcctcgaagcgatcattgaaaagggcaacgaagatatgatcacaaccattatggacatggcccacgagcagaattggaataccggtattaacgatcggtttatcaagtcactcctgaagagccgaaaactcgcaatgaccgacaatcctgtgggaatctggcgactgaagcaagccgccaagaaccgacaagatcatttaacttcttcaaggcgcatccttgggtctagttctgatacttgggcggtacgaggagataaaattgccccgattcatattcccgctgaggaatctttccctcaaacggtgagcgagatggtggcctccaaaactgccagtttatacgttccgctccacaagcggatggagcactttatcaacatgggcaggcataccgatgctctggcaatttacaaccacgccaccaccggcgggtacgttgtcagaccgcttcatttgaagctggctgtgatcgccgcgatcctcagctgcaaaaagacaggcctggcgaacgcgcgacgtctgattacatctgaatgggattactggaagaacgttccttctctccgttatagcaagcgtttcacttcgtggattcccattttcttccaacgggtcatggaagtggacccagaagcccttgggtatggaggcttgatcaagatggccatttttgaatattatgatgtttgtgccaacaccaatggtctttcggtgaaacacttctgcgcgacttcctccagccgttacctcattgggggtggcacgccagaactggccgtcgatctcctcacgacaatctaccagtctcggtggcggctctctcatggattcgaccaggtgctattaaagatgctgctgcgtgcgttctccaaggttcacaacttcaagggggcctggtggtgcataatgacagtcctctcgcggaatgagcccatcaaccaggactttgtcgtggaagctacctctcagttgggctcattggaaaatgccatcagatcctctagctcctacgatgccgcgggtcaagtgttggtactccggaaaatggttggcgcgctggaggccaagtttgaaggtgattcgcgttggtcagccgtcagtgttcacccggaattgaaaaggtcgaatcgtgccaagccgttcgagcccaccgagcaacaacatttactgcccaccacagacctaggggaactcatcatgagctttgatgaagagtgggaactggatctcttactcaggcgcaagcagttcgacgcccctgatcaagcaaagtggtgggctgagtcgaatgtcacaaaatcgcacaccgtcccttcagaagatcccgaatacccgtggaacaatcctgcgaattggggacggcattatgtgcccgagaagtactcgtccgactatcaccttgagttttcacctagaggggaatacgaggagtatatggagtatgaggattaccaggggcatcgggcgtgtcaatgaatgtgtataataatgtaaatagtctgtacaatacctaggtagacatcgatagattcataaatatatacatgtacattgttgtatatctcccgaggtcgatatcactcgatcagtccacctgaagtaaacgtgatgttccctgcggcgtagaattgagaaggcggagagacgtgacctttcacatgtcacgccacccctttctctccgcaaaggaaaaaaaaaacaacatcagcccataagaacagccaatcgactttcctataaatcaattgctcaagccgataatggtcctgcttccgtcgactccgttctgacaatatctactcttttaaaagccaaaatgaccttgctcaatggccacgcctccctctccccggccgctcaacgccgcatcgaacaccatgaagctgatattgtaattgtgggtgccggagtcctcggctgtgcacttgcagttgcactgggaaatcaagggcgcagtgtaatcctgctggagaagtcgttggaagagcccaaccgtattgttggtgaactactccaaccgggaggtgttcaggcgctcgagcaactagggctacgggattgtctggaagatatcgatggcatcaatgtgaagggatactgggttacttactttggggagccggttctcctcgaataccccaagtccagcccaacctcgcctacaccgttgggacgagccttccaccatggccgattcgtgatgaaactacgggcagccgctctgtcgtgccccaatgtcacggtggtcgaaaccaaggttaccggcctcatcacatcctcatatactcaggaagtccttggagtcgagtgtataaccaaggatgtcaaggactgctacttcggtcaactcaccgtggccgccgacggttataactccgttttccgcaaggaacaccaccagtatacacccaaacggcgctcaaagttccatggcttggagctcatcgatgctaaactgcccgctcccaacactggtcatgtgcttctcagcgataatccacccgtacttatgtaccagatcggcacccatgagacccgaatccttatcgatatccctgataacctgcctgcggcctcggtcaagaacggtggtgtcaagggttacatgcgaaacaacatcctgcccaagctcccagagggtgtccagcagtcgttctccgatgccctagagaagggccagctacggtcaatgccgaactcgttcctgcctgcctcggccaacaagacacccggcttgatgattctgggcgatgcgcttaacatgcggcaccctctcacaggtggaggcatgactgtggcgctcaacgatgtttgtgtcatccgcgaattgctcagcccagagcgcgtgcccaacctctccaatacaggccttgttctcgagcagctcgcagagttccactggaaacgaaagaactcatcttcggtcatcaatatcctcgcacaggctctctatgcgctcttcgctgcagacagtacgcacgctcactcttcaggttaatttgcaataactaactgttcattcaacagactattacctcaaagctcttcagcgtggctgtttccgctacttccagattggaccagttggcggccctgtcgggttgttagccggtctaatcaagaaacccctcgtccttgtcagccacttcttctccgttgccttcctcgccatctgggtccacatatgcgatacccctctgtccaagctattcctagccccatactacgccgtcatgatattgtacacagcctctgtcgtgattttgccatacatctggaccgagatctggtactgatctggctcgaatcccgtcgagtggtgacctaatttcccttcaaaaagcgacaatggagaaacccagcatatcattctccattctctccctattgaacatatttgtcgatttcaccaagtctttccgttttaatatcccatcctcgccctgcttttgtcctttcaatgcctttatgtgatttaatcctgtccagcattctctcactacatctgatacactacaagatctgtgttatggatgcactgtactatataccaatctgccatactattatctctatgataaatgatacaatgtcaataccttccaaaccttcccagaatcaacgctatccctccgccaatgctacataaaaatgcccaaccaaaaaatcaaccccagtccattcatatcatttcacatcctcccacccaaacttccaaggttgcttccagtacacatacaccagatacaccatgcaaacacccacgatatacccagcaagccccatcacaacacatcaacacaaagcagatacgccaacaccccgaagcaaaacgaaaacgaaaacgcaaagaagttaggcgcaatcggcatcggggctgacacacgaccaagccagggcagaccaaacccgagctggatattcgaattccaattccaattcagagagaaaagagacatgacggcactgactgatcggatggcgtaattttgcacgaaggatatgctagaataggtctcgcagattacgccgtaggcgaagaaaaagcaataatacaaatacagcatgaatgagaggaatatcatccacatgttttcttctttttctttttctttctggggttttgtgggattttgctggttgggatatatataccctttttggtatatacgctcgatatgtaggcgagtcctttatggagtttgtggtttgtcgtggatcaagtggatgctgtcttcggatgggatttgttctcgatgggttcaggtagatgggagaggatgagcatgagcatgagcatgaagagagggagagaggttttgaggactgggacttctttgttctcctccctttgttctctgtctttgttatttgcatgacttcgctcagggcatcaacactctgttgacggcagggtaagacggggaaatagcagagtcaaacacaatgccaggccctcaggaagtatcagatatcatgacctgagcaggaaaggaagggtctttttcgaaaattttggtttgtttctcattggcaataagttaatctctttctcttttatacagaaccatggccgaaaaaaaaaaagaaaaaaaaattggcataagaaagatgaaaagcatcagaccgggtctaaccgtttgaacacaagaactccaatcaactggaaagaaatcgtctcaatgcatgggaggcttttcctggaaaatgaaccggccaactttcccgatggcaacgaatgcatgcatatatggaccctgatccctcatgggaaaaagggcaaataaaagaaaagaagaaaaggaaaaggaaaaggagcaaaacaacgtatttcaggggaacgtgagttcgtttggggataccgtgtggacggcgatggaatcaggctgatcatgttggacgtgagtaattgttcgatcctcccgaggtcatgatcgtgctggagatagaagcgtaagaaacatttggtcaaccgccttttcgcaaagaatcatctgctggaacgagctcatgaccgctgttgatgccgtttcgaggctccattgacgacttggtgttcttgcggtttttcttcttggtggtctgccatccatggttgctctcgttcgtgccgttactctgtccaccagatcttcggggcgggtctgtgtgtcgatccttggtgcccgggacagcgttgtgagaaccgtcgtgtcggccttgacctctgggcttgctcttgccactaacgccgttcgccttgtcaggatgatctccattggtccggcgcttcgagttggtcgactgatgccgattctcattaggcccggatgtagtaagtttctcgctcgtttgtcccgagggcttagccgggccggtttcctttcctggtccttgtgctgtgccatttcttggtcgatccggacttgtctttgcgggttgctgtactagcttctcggaattcgataggtggtagttctgcagccgactagcgagaagctcagattggccattcacgtctggctgcttttcccccgcaccattgaccttttgagtttccgtagatggccgagtgaagacggcggagtgctccaagtcaaaagacccggaatcctggtaatcttgagacaaggaatcggagaaacttgcaggcgtgttcatgttgtggtcatccgaggacgtataatggcttaccgcggagtaagggtcaaccaagtcagacgcgtacgccgagcggggttcactcggacgcaccgacccatcgacgatcaacggaccgggtgcaactggacgtggagcggattgggcgggttgcgacgggggcttggaggttggggtgtgctccgagcgagcagtttctgacgagaacgatcccggtcggtaatctggttgaagggggacaaacgaatatccattcgagaccagacccatctgtgtggacaacggcggcagcatggaaccttgctggaaggcttgaagttgttggggagttatataataacccaacacatcttgctgtcggttgtcgtccacagagtttgagcgggatccattgctggccagactgtttgaacgcattacattctcgtcaccactgccttctccgccttctgatgactcagtggtccgcctctgttttgaccagttatccgtgggtggcggcatggtataaaggggaatatagctggaaagagagggcgagccttgaggccgtgcaggctgtgaatgcgcacgaagggacttcggggatccgttggcagccgacaatcgccgagaattacgacgagtatcaggcataacactaacggcagatggcgagggagggttggtggtggtcgcttgcgagccagatgcaccaactgaagcataagtagggttataaatcgtttggtgtcgttgagtcgggctgagagtggcgtggcttgctgttcctgttcctgatctcggtcgtgaggtttcctctggaaagtcttgctgttgagggactgggaattggataaaaggctgacggataaataccggaggtggcctcccagtgatcagtgcctgactatgtaattgcatccgcaattcttgctcctgcgcctgcaacagctgtatttgttggtataactggtcatgcagaagatactgggcttgctgttgagcatgcagggagatatctggggcattgccagtgttctgctgccggaagtttgacttgtttccggtgtttgactgtcgtcgcccgccagagagcccgcctcgcgagaactggttattatatctgccgcctcggtttcctccccgtccaccccgcgatgggagggaaggtgtgagagttggccgcggctggggtggtggtcgttcccaggtccgctcctcttctgccgggaattcaaactgctgacaacacccttctagatcaccatttgcgatatacttgaaagcccttcgcaattccaaatgtaatccccggaatgaggtgtcatcggcggtgtttcctaggttccttgacgtgttgaacggctcctccacgcacagtcggttgttcaacatcaggtgccagcccttggcttctttgttgatcagggtgccgtcccgtactgatatgacattcttctcatagtcaagctcgtagccataataccggaaaaattgaaagagcaactcgccaactgattgcttgttcttgcggccaaattgagacaaggtcttgaggtcgtcatcgaacgagcagaccaatccatcgtgagtcatcctctttttgtgcgggcgtgcttgcaaacttggaaggattggagggtttcttgtctgcaggaaattaatgatcaaacagatccaggtgtaagaactaagggttcctccaagggctgcgtcattgagaatcctttgcttcgtccagtgcttgatagccattgccaaaggccgaactctttcgtccacctcaacataggtccgaatcattcgagtgttttctagcgccaaggtattattgacattcatgtcgcaggccaaccggagctccgggtcccaaatcttcacgatggggacctttgcgtgcgacacacacaccacgcgttgcatcccatctgttcaggtcagtctatcattcagggttaaggtttgtcaacagcgatctcttacgtttagctaacacctcagccaacaggcacacatgctccaattccttgtagttggttgtgatgcaaatgtccactgctcaagttagtatttgttttgcgctttatctctcttttgtccaaaaaggctggggaaagcctaccatccgagtcacttgaacagagcttattccctgacgagccaaaaatgttcgccttaatattatgaccaggccattggtcgttgaaaagcttctccaatttccgaacaagctgtcgtcgtcgatcatcactctcggcggatggcaataatcgatcatacaggtccatgatctcggttgacaattttttctcctcgtccgagctgagttgctccttcaatgcacccttctcctccggtagtatatctgcgcctaagctatacggtatccgtcgtcgaaaatacgccatggcggtctcatatttacagcctccgagcggtttccgggagaatgggggtagatgcgtggcctcggagtgggtggatcgaggggaggtgcttccgcgggcgggggacggcgaccgggagtggaacgataggttgcgcgcatgttgatatggggtggaagggagagaattggactggtgcgaagtcaacggaggccgaacggcgggctcgggcacgtcggattgtggcacatcggattgcggcatccatgccatcgtggagggctgcgccgacgctagcgaggcgacgtcacggtggagggaacactttgcattcccatcgatttttgcgaccatatagcaatttgcaactcccacaccgttgtggtccttctgtatagggtgggtgctcggcaaaagagataagagtccactcccacacaccacacaatataatcccctcagtttctgctcagttggaaatcaccggagaaattttgtgatcgatagattcgagcgaggcaggttatggcacgtgtgtaacacgtcgaaggttcgttgatatggtgagacaaccgggaaacagatcgtttgtggtgggagactttcaatcgccctccaccaaagtcgcgaagagccgaattttttttatctttcactcgggaccgataagaattgaagagatgtaaaaaaagacaatgcctcaaccaggagatgaaaataagacaaaaagaaaatagtacggaaaaaaaaaaagacacggtcttcgtgagagtgaagagagctgactttcgaggattggatcaaagaaaatgagacaaaaaaggaccaaagtacaggatgatacagtccgtttgccctaaaagcaagttgttaggaaccagcctgggtttccgattgtttttggagaggaagcgtagccagagagggggatttgagaagttgtgaagatgaagccctggaggtcagcccctgtcggcggtaaagagacactgccgaccgtcccctcttaaagaactccaatcttgccaacgtcaacgattctatgtatatacaagtcgagtaatcgaatgaatatacccagggtaggtatttccaggtttgaagatacgtgttgagtgagaaattccccgttataacgttggacggagcagcccacggagtcagactattgggggatagctctctaccctcatttcttatgctaacaattaggggctaaacttctatcctttgtctctaacatgatctcacgcttatctctttctcactagtactctttattctttttcccctgacccccagaaaccctgaaattcgaaaccagaaggttaaaatgcagccagagttgcccgcagtatcaccgagctatgcattcatgcaggtaccatgacgacaagtttatcgataagacagtcttgttcgttggccgctctggactactagctattcactgaacatatcaattcctaaggaaaggcttacatggtccatatattgtacactccttttccctcctgatcgtcgttcttcactcctccccgcgatcagcatggtccttgcacgtgctgctcactagtataacttaatccatgtcaagtggcctgaggcatgaatatggcaatgtgctgtctcttttcaaagaatggagttggaatcgaggattctgctgacaactctgcatcttgacttgaggatactcatacttctttgtttggagaacatggaccaccattggacccatactttactccagagtccgaacagtggctcttcgaatccgatgacactcgagacgaagagccttgtgagataatattcattggaccattcgtctctggggctaacggaggtatcagtcgtaagatggtagcctttgtttattagggcttgggctcgccacattgggaacatgaggcttgttttggcgtgtttctttgtaaatcaagtaaccaacttccaagactgaacggtttacccctcttcaacattgagctatcgaggtagctctggcttgtgacttatagtccagccttaaccccgaagaatcaagcatccagctagtatggctaggaccaaatacggccgagcacagtcccatgtatgacaagtggggagttattacgcttcccaaggtgacgcggaggcatgattgagcgtatcgtttatcgtgctagtggtacatttccggagggtttgaagggaagtcaacttaatgcctaggtactgtccactggtaccttcctgctagatcgacatacaacatagacgacaactgggcagagcttaggggagctgatattcaggtagacagactacggagtacaaaacacaaaatccctcttctactttatatatctgagtacctcagtgcccccaatatcccgtcccggagtcgattcaccccgatcacatagaaatagtctcatgtacatgcgggggaggactcgggctgggctgctgactggtcgagccgggtgagtacatatattgtacatgaacattctagcggccaatccagttcagaggggcgcggaccttgcggaagaatataaaaaatggacgttgccccacctctcctgaattgaccgagctggtcaaagcaccgttcaaagtgtattctggaagcaatgttactatcgcattgcgtctactcctgtatgtagatataatttctagacttacttgttaataaggctttcaggggatttgcttgaaccagatgtatacaaggttctctacattcgaacaggctacggagtatagtgggctatatatacttattgcatgcatttgtcctggccactatacatggagctgcagatcacattcctgatgcgactagagtgttcacttgcagcctccgatggcgtccataggcagcgtcttggcaagctgactgcatagtgcagagtctttgcagtttccaaggcatcatcatacgttgaccccagggaatgccttgtttatattgggttatattacgagcagaatctcagaaaccggattttagaaacttggagacttttttgaatattgtactgaaatagagtatacagaagacttagggcatacaacataagggcagcacaatgtaaatattcaccgttttaagttgggaattaccaagtttctaagattcgaacatttagattgtagatgtagagtagaatatatacattcaagtatagaagtatacagtaatgaataataagtaatagtaactatcagacacgaggggagctcgacgcttagacacacgcccccgtgtccccgtccaatctccggtgaccggccccagcagtgacgaatagaagccgttgggttgccgggaattgccgcgtacttgggatcttcgatgtacagaaaaaaaaaaaaaaaaaaaagggaattggtattaaatgaaagcattgaatgacaaataggttgatttatagtagaaagagacttagtatgtagttatacttatagtccatatccaacataaaacagaaaggaaggttaatatctcagtttatctcagtttaatacctaatatgttgtcctacttaaaaaaaacaaatacaagagtcaaaagagagtctcctttttttcccccgtatactaatataatacatactaataatatatactaatatgtacggagtactaactattttactcttttacattacaatttatgaaagccccccctctccccccccataaggtaatacacacccacatccccccccagaggaccctctccttttcttctcttcttcatccttccaatctttggactttctctgcctcgttgactcgtggtagaaagaaatactcggaggcctatttcctgtaagtgtgatattgtttctgtttccaattggggagaaaaaaaatattctatacatatgccccaaaatagtttgaaagagcgcagaaaaaaaaaacaccctcgaaaaagggtttcccgagagattattatttttcttttgcgatcttaaatttcgatactttcttttgatgtgttgaaaagaaagatctggagaactggaacactgttcgaaaagtgtgttgtggatcgacgctcacattttttttttctcgacagatcgcctctgaccggatcatcttcccccctgaaccgtcgcaccttttgatctcgacaatgtcttcgtactacgaacctcagggctggcaagcacccgctgcgcgccaggtctcttgggagcagccggcgcctccctcccggtcaggtatgggatcaaatgccgagcaccccgagcagaaaactaacatttgacaggatcgagctcggtctcccagcgcgaggatatcccggccttttcctcccaatttgacggtacggacacacttctgcttggatccctacaattgcctctccaaaaccgaatcgcataacggggaaatgtccggtgattttgaagcgagacggttgtggagatgatatgggcatacttgttttttttttttcctttggggaccctttgggggacgagtgctgatcttttttttttcttctcttcagaggtcgatcgtgcgatcgacaatctcgtcaagagcgggaagctgtggaatgctcctcggcgggattcgatgcccatgatgatgggccggccctaccccgactacggtatgttgcgggcacggatgacacccagaacgcgtttctgacttgtctcttgacagaccctcgcatgggtggtggccctcagcgacaccattcgatcagcgagttcgatggcaaccgcatccccccggctggcaatgcccagggtttctatgcctcccagcggtaccagggtcgtcccaacgaggtggaacagatgatgcaggcgaagcgtcggatggcagcacagcgtgagagggaactccgcaactatcaccaggagcaacagtacaaccgaagtacgtggtagcgtctgtcttcttctttttgagccttgttatattcccctgtcggcttttcttccctcttctctttttcttgtcacatccttgcatctatgtatccgtcggcctgtgtaatatatttggtttggcttcttcgtttttctttgaacacggggttttaatacttttcttcttcctttcaaggcctcctcgccgagatgtctgcatccaaatccgaccgctccaccagcccggctgccgtgagcgaggacagccgtcgcgaactcctcgcccgccagcaccgcgccctgtacggcaacgaaagcccagccttcttcccgcccggtgccttctccgatgataacccgcgcccagatagccaagccggcggtggtaccccgtcgtctggcgtgcgtggatcctccccgcgaggcatggacccgttcggcttgacacaggctggcaccactaacgccgaagccaccacgggcctgcagtcaccctcgcgcgccaacagcacctcctcgcctagctccgccatcaatgccagcttcggcaccgagcagcccgtaacttcggcctcttcgcccggcgccgactcaccctcatcccgtcaggctacttccaagccggctgctggtcctatcggttccgtcggtcccatcggttctcggcctgcccctggccagacatctgctccccccgccaacccggccttgaacaagcgctccatcactcctctcccctccccgctcgggctcggcttcacccccgctgaccctactggccccgcgacagagcgcacctcctcggccggccctaccccgcctgtgacctctgctgctggtacccctggcacgaaggaccaggctggtggtgttggcctcggctggagcaacggcagtggcgtctggagctctaagagcgggcttggcgtgcaggcttccgtttggggttaaaactccacacccacaccgaatttctgatttttgatggcattactccagtgggcgcttgttgcatattggactcggggttgagctggcttactatataccaggcgggggaacaagacgaaggtttactggggtttggaaatattcccccaaattgtgaatctgtctggatgatatgacgatgccttcttcgcattcccctgttaggtcttgggttcagcatgttgttttctgcttttgtgggtttgtttttgctattccggtgcccgtgcgaatatggtcggaaatatggcgctttatctgtgatgctcgtgggctatgtatgggctgtctcatttttctcggtgttcttcatgtcggatgcacaggtctcttttatatttttcatctttgggggtggtacgggaaacttgcacattgtgatttttatttaattttggatgtctgtttttactatatatctccatattgagatggggaggcgaacagaggctcaaaacggatgtttcttggatttggagatctttaattgttttcacttttttctcttattccaggtgagggttgactatagcttggttgatgtaagggttattggagtctgttctattttcaacggatctgggtttcgtttggatttgatttctaggcttcgctatggtctttatagggaagggaaaatactatgtccttgcatacctatctgtttctcgttgctcggtgtctggcccgacaaatgtacataggcacgttctataacgtgtctggcttcatgacatagtaatgaccccttctatattgggctaccagtcctagtaccaggattccattgttgcttctggactatgctgaagacgtatctagatgcttagaacaggcgatgaaccgtccacgggtgtattgacttattctcaataaagattggtattgatctcagaagtagcaataatctgaacataattaagcattagttgagggcacgcgaacaaaatcgtccttttttctcccggtccagcatcgaaaccaccccggcacttctcagtagcaagggtagcggtaacacggacctgacgggcatatatcgcagcacacaaaataaaatctgaaagatcttcttatatgtgcggtcccatccataatcataaacccccgaagatatacaaaaagaaagcaacaatgagatccacggcggttaacaatcagacagcgctattgttcaccgtcgtagtgtgcccgggggtatgttcaggggtctgaccatattccgcagcagcaggaacggtatgcacgatcttcctcttcgcagtgaaaagaccaacaacaccacgctcctggttagtccccagccagggcttgcgggcttcacttaagaccttctgagcgaggaagtagatgagctgaccgacaataatcagaacaaaggcaatcgggtacatccaatggatagagtagtggaagaccttgacgccaatgatcacaccccagaagttcatggtgagcatggagacgttgaagaaagccgccgatgaaagacggaacaacagcggagcgagacagtagaacaagctcagacacagggtgtagccggtgagatatccgccgaccttgccgttccagtgcgcattgtggaaggaggtccggtcgaagataccggcctgcacaccgttgatgatcattgcgaagaaggacatctgacccagcacctcgtacacaggccgagtgctgacgaagtactcctctcccgtattggtgagaccatagaagctcgcgcctaacagcgcgaacaggtcacccttcagttggttgccttgggatacgtttccgccgttggtaccggtgatgtggtccgaggcaatgaggatgcccatgccgccgatgcatattatgatacctgcaatttgggtgatgtggtagcgtacgcgcaggaacaggaatgagatgatgacgaccacgacgatggcccagaagttgatcaattgcgcgcttagcatggttgtgtattggtatgctaaaacaatgaagtagttgccttccacgtcacagaaagcaaggatgatgtctgcagtggttagtcggggttgtatatcgaatatgtggggagattggggacatacatttccagccgtcacgccataccagtcggagccagcccttgaagccgtaacggtacatcgtataaggagtgaaaatggcgttgagtagcacatagtttaggaaggtttggaacgcagggattgcccattgttcctggccgagtagcgttgtgaatgtacccgtcgaggtattggcaatagcgaggatttgactgcgagaaattgagttaggatttgagcgactggtagtttctgaagtgatactcaccctagagccaaggttatatagaattctttagtcttgaagtagccaaagaaccctttcttctggtcgactaggtccgcaggttgcacagcgcgctcagaggcatccgcctgggaactcgaactctgtgcgcccgcctgagcatccttggatagtgagcgggtagaagtatcacggtctacaccagatgcctggacggtgacttggtccttcgactcagacatggcgaattgatgcgtgctcagaaagcggggttgcgttttaatgatgcagatgacaaaccggttgcagtcgaagtattagagcaatagaaagggagctttataagattggaaaacgagcgcaaaactcccgaagtcgctcgtgtatcaatataccgtttggcgatgaatcggacgaagaagcagaaatctaaatgtaacccgaggcctaagaaaaaaaagcgtctggaacctttcctaatcgggccatctttgataagatccacactgttaaacacagccaatcaatgggaggatagtgggggcggtgagggtctgtgctgcggacattgccgtccacctggtcttttatgtcagcagcttttaggcaaggcgcctggttacttggccgatacttgaatagagaggctaattgtcggctttaggggaagtactttccatgtaccacatcccgtagcttgtggagatccatgcgttgagttgaccttgcagagaatatttatagatttatagattgatagatgaatcttaaattgtgttggattttgttttgtattgtacacaagggctaggactcagctgttataaatacatgtactcgatggccatcctccatggatgtatgtattgactgaccccattccgaaacccctgagaaagaacattgtagaatggattccagatccagcttctgccgatcacggaagaacaccagaaggacgaagataaggtacgtctagattttatcataagctgcattcctagtggtatagcatatttctgcctgtacataatgtacatacatagggagtcccaggtaactatatagtctgaggtggttataggtactttggataccttaggtacgccgtagagatgatagagatgaaatagcgataaacagggatcatatggaattctggaaggattgaaagttcccactttcacttcatatctctctaagaagcttcttcttaatctcccgaggttctttcaaggggaaaaaaaatccaaaaaagcccaagtacctgccgaggccgtcaggtggaccttcagaactgttcccgatcgtcatcccctccgcagactctttcatcattgggatctccacctccattccctctttgcgtccctttcaaacccttttcaaacaaactacacaatcctccgataaccttcttttaatttcattcttttcccccacaccgccctttggctctcctctcgcgccggtgcacttttatcaggcccggagtgacgagacgcctttccctattcctgccggaccatggcgctggaagtacagccgcccgacggtcgcaaacgagtgaaggtttatgaactaaaagataatgattggtttgaccggggaaccggcttctgcacgggtcagatcttgggggtgagttgtcgcgtgttgtgcgcgcactgaggctcttgcgacgatgtttcatcgcgcgcaatcccgagcgcatcatcatcatcatcagtaactgatcgctttgaactaggaggagcctcgcatattcgtcgaatctgaagacctacccaatcgtgtcctactcgaaacgcggatcaccaaggacgatggctatcaaaaacaacagggtacctatcccgtcattatcatctcatcgctgtttggtgtcttttttgactaactgtaccacgcgattcagagactttgattgtctggaccgagcagaatggcacggatatggcactgagtttccaagaggcggaaggttgtgcggtcatttggtaaggaatcgacgaaaaatctttgcgcgcatgaactaacctcatcaaagggactttgtcaatgctgtccaacagcatctcttaagtctcacttcagctggtaaggtttgtcgcgtgtttgaaagctggcagctctaattgttctccaagacgacgccttgtccgacgacctcgatagctaccagtccatcgtattacccggccccgaactcggaaatctccccgaaattgaacaaattgtacgagcagcgagcatgacacagaacggtcgagatgcgctatccaagtacatcattcgcgacgagtacatctccaaattggtaccgctagtgacaatggctgaggatttggagagcttgatcgatttgcaccgtttgtgcaacatcatgaaatctctaatcctgctcaatgacaacaccatcatcgaaaccgtcgtcgccgatcatatcatcctcggagtggttggggctctggaatgtatgctctacccagattcatcctggtccaagtccaatgcaattggatactaacgaaaatagatgaccctgaattccccacacataaggcaaaccatcgacaatacctcgcggacaaatcgagatataaggaagttgtcccgatcaaggacccgctcattcgccgcaagattcggagtacatggaggctgcagtacctaaaagatgtggtactggctcggatcttggacgacccgacattttcggtgctcaattctctcatattcttcaatcaaatggagatagtgaatcatatccaagcaaatgggcccttcctgcgtgatctatttcaggttttcgacccgagaaatccggaccagagacgcaaggatgatgccgtgcagtttcttcaccagtgtgctggcatcgcgaagaacttgcaggcgccgtcgcgggcccaattattcgccaactttattagccatgggttgttcgccgttatagcgtttgccgtcaagcacttgaatcccgctatgcgcacgactggcattgatatcttgtcggctctgttggatcacgatccagtcatgatgagaggttatatgctaaaggctgtcaatgagaaaaagacaccactcacagacaccttgatcgaccttcttcatgtggagactgaccttggcgtcaaaaaccaacttgctgatgctatcaaggttctccttgatcctcagattcctatgcaggacccgcttggtcgggctggacccgattacttcaaagttcgcaacaacaaccttctctctgatgcatttgtccagcaacattttgatgagtcgtcaaaacggcttttccaaccgcttaaacagcttgcaaatcgcacagcccgtaagtggttagatccttggttttgatgaagactttgctaaccttgagtctagttaatgatttgacattccaagaggtcaccctctactcgcatcttgttgatatcctcaccttcttcgtccgccagcatctcttccgcacacgtaactctatccagagtgaatcactcgcgcctcgtgtggcacaacttctgcgggcaccgcagaaacacctcaaactcggtgagtgtacagcccttttttttgacgcagaatccatagctaatacagacaagtcgccctcaaattcttccgcaccctgatcagtctccaagataccttctaccaagctctcatgacacacaataacacgtttgagttgattctcgacatcgtctacgagacaatgcctcgcgacaacctgctcaactcggcttgtcttgaactttttgagtttatcaagcgggaaaatatcaaaccttttattctccatgtggtcgaaaaatatcgcgagaaacttgagaacatcatttatgttgataccttccagagcctgattcttcgatatgaccagatgcaggggtacggagccgaggcggacgcgactctgttcagtcaggatgaaagcaccgctccgcggagaattcctctcaatggccagcgctggcagggtgctagggagatggaccccgcggaagaggattatttcaacacgtccgacgacgaagatgaggtaggtaccttttggattgagacagtttgagcaaacgactgaccatttaagataaagtggacacaggaccgtgtggccactgcggatgaaccttcaagcggatccgcctctgcggtcgtcaaaccattggttgactacccagatgacgacgatgaggacatcatggacaccaaacccgaaggtgcagaacaacagccagtggccagtcccaccgagatcactgaggttcctgcgtcatcactcacccaaacgccccctgcgccgccggagcgaattgcggagaagcgtcgccgcgaggaagaagacgatgatgagctcagcaagcttactgcgggacctaagcgaagaagttcaactagtggcaattctggcgcctttaacatgaatcggaaaaagaacctgtctgctggctcactggcagataagaatgcctcaccaggtgtattaaacaaggtcaccagcgccgcgcccaagagaatcgctatcaatattggatcaacggcaaaacctcccgtgtcagaaactgacaacccccgcacagaggtgacgagcgagagttacgagaaggagaatcgcgacgacagtcagggtaacgagggtggatgaatatacctcataagccaggcgtttttcttgaattaagtttccctttcaatggccttgataccagactcgattgcgggatttcccatattccatctcttgctgttctttgggcgatgccctttcttcttcttccgtttcttttcttcttttcttcggggtgctgcccatctgcttccctcctgattttacgaggttttgtcttctctggcctgaactagcgtctagttgaatgttgatgtacatggcatggcgtctgggcaatgcattggatctagccttgcggtgtctattctttttattttcctggtcggactcggaacccgacaattggcagagccctgcatctgcggatggagtcgttgcaatatatcctgctatcttcgtggtgttctttacctgttggaattttctgtagtgccgtaagcacggccttcgcagtatctgccctgccagctatcaaaatacctatacagcccagcaatatctctctgtgtgtttctttctttttctgactttctttatatatttttcgtatttttcgggtggtcgatcggctagcatggatggctctcgatgtagagtgcttggatccaccagccaaatccgacttcacctccctatcaatccaacgcaattcgttcatcaccccagggtaatcatatacgcgagaaatatacataacaaaggggtgcatttcgtgtaattccgtcccttcaattaacttatatgcatctggacaacaactaacccagcccaggccacccaaccaacccgtaaccatctataccctggatggaacctacatgggagagccctacagcagatccaatgatacaagctaaacaaaaaatggcacctggaattaccccaaacaccttcctcactaccacaggttctccatcagaccaaaagaagacaatcttcttcatctccggcaatccgggtctgatcggctactaccacccattcctctctttactctcaaactatctagatgaggaaaaagaggaaaatctaccaagcccaccgtcttttcaaatatacggctgctctctgggtggctttgaaatcgacgaacgccagtcctcgccatcaaacaatagcatcgatctggacctggaagatcagatctgctttgtccaggacaagctcactaccctgatgggggacgaaggcaacggcaacggtaatggtaatgccggaaccagacaaaaagtcatcctggtcggccactccgtcggcgcatatatcgccatggaaatcctaagacggcaccgtgaatcaaagccagaaagcgccttcgatatcatcggcggagcgatgctcttccctacagtcaaggatatcgccgcgtcgccttcagggcagaaattgacggtacataccatattcctcttgccagatgcttgtgttttgattcagtttcgtggctaatctcagctcgactgcatagactctactttcaatcattccccgtctggctgtagtggttagtctcttcgctcgactacttacattcctgctcccggcatcacttcttcgacctgttgtccggctcgttatgaacgacccgcccgttcatgctttggacactacgtgtggttttttgaagagtcggggtggggtacggcaggctttgtatgatattctctttttggctggtggtttgggttaatctaactaacttcttctcctggctagacatatggctgctgatgaaatgcggactatcacttcggacaaatggagtgatgatgtctggggtgctgcgtcggcgcgtgagcctatcgctaaactgtttttctattttggtcgtaatgatcactgggtggctgatcagacgagggatgatattgttgcggtgcgcgggcagaagggaggacaggctgggccgactatggttgtttgcgaagagggcttgccacatgcattttgtctgagtaagtggatttttattgactttgactacgatacgtagccttgctgatattttgtagaacacagtgatgtgatggcgcaaaaagttgcggggatgattaggcagattgtggcctgagggagaggctacggattttacgatgcatcgaaatagacaggagctatatgaagacaatgaatttcgccattggcgcagactgtaacgggtatctcaagagacgctacgccacgcccattcccatccgaatgacaaagagcccaaagctatttaaatatgccggaataaatcagaaagctagacgccatgtacaaatgcttgaggggcccgaaggaaacatccagcactcctctagtgcccttgtacattgctctgttgagctaatcctgccctccggaataagtctcctagcacatcggattgcggctggggcgggggagtaggagccggcatctgatgaggcaccatatgttgatagttaggctgctgctcggggcccagatggtgtgctcgcacactccaagcgtcgtcctgggcgcgctgctgaccaaacagatccttcagcgaaatctgacgtcccataggcacgctagcctgtatttcctccatcggggcagtctgtgaggaagccgccactgccgcgacgtgcaggctgttctggcgcatagcttcgaggcgcccgcgagctagcttcatgctctcccccgcatgggtggcgcactcacgaatcatctgggcgtttatggtgcgactctccgcggtggagtttggcggcggctccgagtagatccagagaccatagatgcgcacgttgttcgtgccggtctggttgttgggtacattctgcgggtgcaagggatcggcgatgccattctgtccggcttcaccttcactttcctcagctttgaggatcacatactcctctgtaatttcgacattctcgccatcggtgagggggagatcgaaattgttcaacccgcggcggttcagcacgaaggcagtgtagcgctcttggcctagatcaccttgtgtttcctggcagacaaataaggttccttcaaccccgttcttttcccattgttttgtggtggggctgaagatgtagaccactgcgtagggggcaagtgaaaggatggaggtcactgagggcttgtggcggcggataacagagaggttgagctcctcgttcgagcggagcgggggtgcaggctgttgctgcatgtcggagtagtatggggcgtcggattcataatcggtgagattgacaggattgtgattgttctgtctccgaggtttgcgtgaagtcatgttttctgtgggaacgcttggaaggtgtggaaggatggaaggagctgatatcgtcattgcagctccgccttcgcgcttatccggcgactctctactttctactctccgaccctcgaagctcttctcttctgaacctcatgtggggtacctgggacgctggcatatatttgattccttcacaattggtttcaacatattccctattccctatattctacgtgatgacgatacgacccttctaaaccttggtgggatgacctctgtgatgaaatgactgagccattgtcgcattatacaactgattctctcaattctctcaatttatcctatcataaccattatcctcttgttcttctattgcgacaaacccccaaagcctattttccgctgccggaattaaaaaccgcgcaagcgcacatacatacaccaccgctacaagctgctaccctaccgaaaccgcaaaccatagccaagcgaggcgaataaactttcttaccttctgacaccaccgtatactcgtacatcatgagctctaaatcgcaatcgccgtccgcatcagaccacaagggccacgagtccgaatacgcggaagaggttaagaacccaggactcgacgtttcgtctctttcgcgtgctgtcagagcaagaaaagatgaatacacgcgccggaaatctatccgagtcaaggtcgggacatggaatgtagccggcatctccggcaccgagaaagacgttggcaaatggtttgtccaaggagacggggtgtgcccgaagttctctgggacaaactacgcacacgcacgaaagccagaatccaaatcacccagcaagcatgatgagcagaaatcagacggtgacaaaaaacgaacctttcaccacagccccgaggagatagacctgtacgttttgggtttacaagaagtggtcgatatctcttctccaacagaagctctccggccatatgttgacttggcaccgtccaagcggtggaaggaagcagtccaaaaggcgctacctggaggatatcagctggtctctgaagtccagctggtcggcttgttgcttttgacatatgcgtcacctgccattggagatagtatttcttctgtctgtagtacatctgttggtaccggactgatggggtacatgggaaacaagggtgccgtgacaacgcgccttgtcctgggcgaaacgacccgtttggtctttatcaactgtcatcttgctgcagggtccgacaaaggcagcttggagcggcgcaactgggactcttctcagattgtccagcgtgctaaatttgacgcggtttggtccgacgttgatggatcgggagaatcgggcgaatcaataggagatgaagatttcactttctggtttggtgacctcaactaccgcctcgatgatatctctagtgatgatgtgcgccatgtcctcgctcggcatactgccaatgagtacgacaaagagcgccaagcaaagcagtcgtcaagccattctgaggactctacggccgattccaatgatgagaatgagtcgccttcttcttctcccccaaaagaaaaggagacggggccagacaccgaccctgtcactgatgatgagattgatcctcataatgaccctgcatctcttcagactacaatttcctcacttctcccgcacgatcaactaggagttcaacaaagaaaaggagcagctttccacaagggttggcgggaaggtgacatcactttcttgccgacgtacaaatatgatgttggaagtgtggccatgtttgatacgagtgagaagcaacggggccctagctggtgtgatcggattctgttccgcagtcttcaggataagctgagacatgagaagctcgaccaggaagcggaggaggcccgaaagagggatgaggagatgaaggcaagcgggctggacaaggctgttgccgatgataatgtcttgtttgaatatgaccctgatgcagacggtgcaaacagcgaggagtacatatcagacgaggagcaagccgctgatgaggatgctacgacagtcgcatcactggactcttcccatgatccaatccgcttggaccactatgtgtcgcaccaaggcattctttcgtcggaccacaagcccctagatgctgtcttcaccttgagttttgatgcggtcaatcgcgaactcaaagcgaaggttcatcaagaagtggcccgtgaattggacaaggccgagaatgaatctcggccggatcttactattgtggtggataagtatggtgaccaaaagcacacagacaaagacccggacaccgtcgatttcggcgatattgcctttgatgtgccagctcatcggtccctaaccgttgccaacaccagtggcacggcagccactttttcatttgcggagcggcatgaaggtgacgacgagggcactacacaaacaccttcgtggcttgttctgcacgtctccaagtctacagacaccgcccatgacactggccaagcgatgacttcttcgtctgggaaccacactttgctccctggggaagtagcaaatatagatgtcacggcttacgttcgtagcatcaggcacgtccgcttgctgaatattggaaagctcaaactagaagacatcctagtccttcacgttgatggcggccgcgaccattttatccccgttcacggccgttggctacccacctgttttggttgcagtgtcgacgagttgacacgcatgccagaagcgggtgctcgaagtttggccgaatcagacacccctcatccatcccgcacagatagttccactgaaatccgtctgtcggcaccccgcgagcttttccgactgactgaggcgatctcagagttgacagagcgcgccgtcgcggagtggagtatgacaaatggtgaatccgaggagcataaagccccatgggcaacggatacttccggtggagcatggcccttccagcctgatacatggactctaaaggacccacaggagcgtgctacgctgcaaatttccgtgcgtgaagcccttgacaccaacaagtccctcacttcaatatttgcccctgagacatcatctcttcatcgcttggaggtcctatctgaaaccctcctcactttcctcaacgcgctccaagacggcattgtcacggcgaaagtatggcaagacatggagcagcagataaccgcgcgcgagaagagcaaatcccctcctcgaaactgggaagaaacccaggcctgggtgcttgagcacctagcctactcaccagcgcacagcgtatcattcacatttgtcacttttatgctcgcccgcatcgccaatgaagtggccccggtatcgtccaatacacctttggtcccaatgtccaagcaaggaaagcccgttgtccccaacgagccgagagatgaacaggctgggactgtaagccagaatcgagctcaatctcctactccagcttccgctactgccttcataaccagtggcagtttccgccgcaagaaccgctcctcgagtacatccgctggcactagccctgactctactggtcagaatcagtcgatagcacgtcgacaagcagtcgagactgctctagcatctgcctttgcactcgtgcttatttctggctctgctccactgccgcctaaagagaaagagcgtcgtatatctgaagagcggaggcgatcaattattgaaccgttcttgaagatggttgcggtggatgatcgaggtccatccggaggtcggtcttgatttttttctgatacagtcgagagggttgcttgcccttgtctcgtggtccggccccgggtaattcttatcaaaaacccggccgtgttttgactcctatagacttgactttcagttgttcgattgcatcgcgttgtctcgatatgtataatgctgtacaagtgccatattctcacgtttttcttgcctatgaggattaatgatacaggctaaaacaacctcatatttgaactaaactcagtattccatcttaaaacatgatagatcacgttacagaagtacttaagtccatacataaacgccaatatactcgtggaccgatcctgcggtcatcacccgacgcccatttcaaacagcttataggccactacatatcttcagtcggcaataaaatcgaaaaaatggtccatataggtcctcatcccataccatccccatccctgaccccagaccgccgctgcgagaccagcccaccaccctgccgatacccacccgatgacccagcccccgcagctccagctccagcgccagcgccagcgccagccttccccttcaacccagacctagactttgacctctgctgcggcgcaacctttcgccccatcagcatacgcctcgcagcatcccaacaacccgagaccgcacgcccaggcaaactaacaagcgacagcgcaatctgagcagggacaactatgcacgcgcaagcccagtccagcaggactagcgcgtaattcggacgccgggactcagccgcccgcttcgcagcagcagcgagcgcaatggcgtcaccggcctgcgtctcaagacgcacgaaacgctgatcagtctgcagagagaagagggcggatcgtttctcgtagcgccggactgcgcggttcagggcttcgatatcgggctggatagttttgcgggtttcgagggctgcactgacgactagggatggggatgtctggtcttgttcttttggggagaggagggggtctttatctgtttgggtggcgagacgggcggttgctgtttctgcgacgtgggtttcgagttcttcgaggcgttttgttaggtcttgtagggttgttgggggtattgggtctgttgaggatgatgcgatgcgttggaggtggagggtgcgtctttggattagtcttaggatgtgggcgattgggcggacttcggaggctaggaggaagattgttaggttgtagtttgatactaggccctctgagggtcgggagaggctggagcggatgccgtggaggagacaggtgccgattatggggaatatgaagcaggcggctagagcggtgagttcgtggatgtggagttcggagatggctgttgctgcttctttgttttggggttcttggtcgtctgggtcgaattggggattgtcgggcgctgggaatccactttcttctcgttggatggcctgggctgagcggtaccagtccctttgtgcagttaatattggtacttttattttgggagatcattgggggttatcgggggatatagggggacataccaaggcaaccggacagaccagttgaggaatatagcagccaagactagtaatgtgacgtcggtgacgaaggaactaccttcatggaagaaaattccggcaattgcaggcagcagggccagcccgagcggggcagaatgccaatgcgattcttcttcttcagttgagagtgtggcatggtcttttgctacgcgaggtagaaacaagtcgtcggtcgatgagcggatcgagttgcgggcctctgagatcgagtcggagagagtggagttccgtcgttgactgtcgaaggtataggcacgacgtggtttcaaggaaggtgaatcatccatgttgatgaaggttgggaaaggaatgtgttgtctgtctctattgctaccccgtgcagagagtatggggtaaccttggaacctttgccgaggatgatgcaataagaaccggttccatggttcgcagatcccaaactggtaattgtccactctatataacacatctatacacttcaactatattctatatttctatatctcacagttctcgaataatattatcacatatttcatatctttctctcctcgtctactaagctggattgaatatttggtgatatgaagtactcgagagagtggggccagtgaggattagactgtagccttgagtttcgggtcccgtcgttccagatctacattaagcttactgcctagaaagtcgttcaagtgcccatgcgatcaaaaacctccaaggttgcagacgaaattatcagactcgttcgacaacttgataagccgtgtgtaccgttagacatgactccagcagatgccaatgtggtcgattggcgggcatcgagcaatttctttacaatggacgccattactgatattggactgaatgctcctttagaatttctggactaagcggatgatatcactgtctctgaatctattgatggcgctagctatctcgaatgttatccagttatcgcgactgtctttatggtcaattaagagctatcccagtacttgtttggtcctacagatggtactagtcattttgcaagcggagtcgtcgcctgtcgactagctatggcaagctattagataaaggcaatgaatctgacggcattgtcgttcatcaagcccgccaacgcctcaaaagataacagagtggtgagaaactggagacatcttccaggctttaatggaatcgaaagaggatggccaaccatcttccatccggagagattgtcgtcgaaatttctattatatgtaagtagcacacgactctcgtagaccagctatacctaggtacagaatagcaggctaatcatccttgacagtgaacgccaggtccgtctccacggcaatcgcaatcaacaattcaatgttcctgctactcaagaacccggacaaactcctcaaactccgagaagagattgatggtgtaccggatgaggatgttatatagttactaaataaagggttatttaaaaactagggtatcagagcagtttgctagggaggaatactatagaaaatggcactcgtattaaaacctgactgctaggagtgactcttcctaattacctaggtaggttagatgactacctgaggtatgtatccatggatagtgtgtgtagactggaatgttgagggatatcctctccaaacttatcaactgcatcaactctctcccactcacacacctccgagaactagtcaatctgatcaatctgatcctcaatagactagaaagtctagatcaataataaactcattcattccatcgaaaatatgaggcggatgcaaatgaataaggtccccgcctcctcgggtctattgacacccaaatgcggactggtttgcctcacacgattcgctcaacctacactccacacctatgtgcttcgtatttctttattcatcttctttcatcttctttattttctttattgcaagtcgttgagtctaattcaatgctaatccaatggataggtttctctgtctgccgcaaaacatgtcaaggcctgatgtccccggcgggttttgtctctgcggcccatacattcttcgtgaatagcacccgacttcactcaaggcatgatgtcttgagctgtgaatcaacctcctgattctcactattcagatttcaataagacatcgtccctcaatcgtatcccctggccgggtatacatccttcagcgagggaggatggttttatcccatccttctttctttcatcctatctcttcgtttacttgagcagttcactgaagaattagagacgcagattaccgagatactcgttttaatctctgttttacatctgccgtcatggatattcaccaaagacaccctcaggccgtggctctgccaatcctgtcttctttctctattgctctcgccattccaccattaattctgcatggaaagaaccgcaacttccctgctaccagtctgatcttttggtcaatcctcctcaacttgttcaacatcaccaacgcccttatatggcccacggacaacgtggcgtcgtggtgggatggggctggcctctgtgatatcgaggtcaagtttatggctgccggctatgtgggcattccaggaagtctggcatgcatcttccgaagccttgcaattgtactggacacagaccgggccacattagtcccgagcaaaggtcaacgctggcgcaatcagttcatggagattctgttctgcgtggctgttccagtcattgcaatgatcacgcatatcgtctggcagaagagtcgatacctgctatttgccatctcgggatgtgtgaacaacttcgacgagagctgggtcagtctcgtctttgcatggatctggccgccgatcatctgcctcattgcagcatactattgctgtaagtatactcccaacttcctccataaaaaaagatacgaaaagcacaccaactgactaaaagttccaggcctggtcctcatccgcgtacacaagtacagaaacgacttcgcaaacatcctccgcgcttctagcagcaatctcagcaaatcccgcttcctccgcctcttcttcctcgccctatcaatgctcgtctgtatcctcccactccaaggctatgtcgtctacgccgacataatgctctccctcccctggcatccctactcctggagcaaaatccacaacggagaatggaataccatcgccaaagtccccatcgacggcaccgtcttcttcgaccgctggacccccgtcgcatcaggcttcatgatcttcatcttcttcggctttggccgcgacgcaacccgcatgtaccgcacagtcttctggtatctcggactgggctactgcttcccgagcatccagcccccaacagagacacacagcaccgcgcattccccggcgcacgcctcaacagcaaccaccctcgtcggcagcatcagctcccgtgccaaattgttgttctcgcgccagaaggaatccatcgccacttttgtgtcggcgcgtgctacatacaacgatcttgaaaagggcacctcttccaccttatcccgtcacagcgacggaaagtcgaccaagaagtctcgatggagtaacttgccctggtcgctctttaacagacgtcagacacgtcaggatgtcgatgggacactgctggatgatctccccggcggtacctcgcagactgtctgcacaaatgcttgggctagtcgccgtgatagtcgggacttgtccagtgggccgacttcaccggagcaaaatagagatttcattcatgtgcggcaggttattagccagcagagtgaggttagggctcaggtctagtgggcttgttcgttcttcggattgttccgaggattgcagtggcttattacggttcttctaatcttgcctttacgttagtctggggtcgtggggttctgctgtacacgaaagtagtaatactaagtaccataacacataatagggaggctcggcaaaatggaaatgaatgaatttgtttgaatctgtttctgcttggactgtatgttccatacacccagcttctgccatgcactcgtcccatccacccacacgcgggcatatcgcctgtctgctcctctcttatcacatctatggacgtctcttttgatttctggtacaaatcagacgaaatgcagtcagcggcttgggaaaaggcttaccgggccttatttggtctgttcgagcattacttctacaatgttcgctcgttgtgcttgacgatgcatatgcatatgccggcctgggaggaggtgagagggaggctaaacgatggcgggataaacgacattcataaaagtcacaggtagaattcagaaaagccagtgtttgagccaggaatcgagctttagcatacttagagtgtacgcgtactacacatgctaccaagatctcgactacaaaacgaagtgtattcagggtataatcgtacaatattatcacaccgcgaaggaggattcactcaacacagccccaaaatgaaagcaacaaattcaggttgatacagagccttaatcaaacaatttagtgagactcgtcagagtggccgccgttatcgggtcgcttaaggacctcgagagtgcctagaggagtgttagattgaattttggttttgtttccccctcttgtttccgcagagtgaaagcaaactgagaaaacgggaatcgacatacgctgcacaacgtttagagaggaccgggtctggccctcggaatcttcccaggtggccattttggcatcgccctcgacgtacaggagggttctatgtggacaaagttagcttatctgcattaatcccaggttcaagttactgcattgatgcaaatgggcagaggcaactgagcaaggcaattgtagggtaatcccataaccccaccccctactgctcaaggacgaacatgacagagtcatgtctcatccgaaggcgcctcgcttcatcgccaaatcacatggcctaagtccaaacatgcccacacgatcccattgcagacttcaagcgcgagcgcaagctctcgctctcgatccgcatagaccgcgcggacgtgccggacccaatcggcacgatatagcaacaaaacactcgcggacaagacgccattcaaacatgcagtactgtgtcgcatacaagccagaaatatatcaagggcagcgacttaccccttctgcaagccaaggacgaaatcgcgctgggagccctcggggacgaagttcgtgatgcgccaccagctcgtctggcggttatcgcgggggccgtgggatgtggcgatgttgtacttgacgatctcctggccggaggaggtggcatggagctcgggctctgcgccgaggcggcccgtgagggtcaagcgggcgatggagtgggcgggcgaggagctgaaggcgcgggcggcctggggggcattggtcatgcgcagggcagggcgcagagaggagaagaaggcagacatggttggatggaggatgttgaattattagattataaagtatagcaaggatgggttcatcgggatttgttttggcgtgttgatgtcgataacgacacgtgatctagggggttaccgctttcggatgtgatatgacatagacactacatccacctggggtatggatttatttaggctggctattactgtaactgtgactgtggctctattatgggttgagtcaaggatttggatgaaattgagacctccttgggaatggagttggtacagagtgctccgtagtcattttcgagctcataagctcatacccgatagctatagctttagctataacaagagcatttcacgtttccacgccacagataatacagtaaacccactggatatgttgttggcagccctcttgctctttcacaccatgctccttattgggaagcgtagtattgaccatcacctcattagaaacccaccttcaaaccagtcattccactctggttctccattggaactccaagctttccttgattttgtaagtgcccccaatcataagatgtcattgtcagtcttgcccgacttgtgctgcaggcaatcacttatgacgttggaaggccttgaaatatgtactccgtttaacttgaaatgaggtcggcctccgtttatgcttgcagcattaccttctttcttcctgtcgattattgcggccgatgcctacatatgtaggtgtaatcctagagaggaagtttcgttattctgattgatgcgcaatgtccggaagccctgttcaggtggatctccaggctcgcatcccataaattagtcatcgtacacgtgatccatgatacggcctcgtcagccctggagtgattctgggctgaccccgtaaaaggggcctgctaggatcaccctcgcagacactttcctgtccatacaatatatactccatactccgtactccataggtgcatatctactccgtacgggagcagacagctataggcgtcggaattataaatccagcgtctcccgttccgagtcgaaataaaaagcaaggaccgaaaaagtaaagtaatgcaaatcaaatgacgagcctcactctattattttgaagtcgtacgccatgtgaacgccaacacgaacacaccaggctatattcttttcagcctacaacaaatcatatcacaatccatcacatccgacagtcccgcaaagattgtacggagtaccgagtacgaagtactccgtccaagtgcacaattgtacaatgtgtacaaggccaggcacaccaaactggaaatggcagccgataggcagatcggctaggggtcagatcccagtggagatgccgcaatatcgctgattgagtgaaccggaccgaagataaattaagataactgttgtctcagatgtactccttgcattgtcaattagcggcccaaccacgtcgctgcggagggggcgtttgcgagtcaacaatgggctaacatgacgaagacggcctggacctgcaggtatctgcatgacaatggtgagattggtcaagtcaaaaggtcgaagttaaattcgtcaaaatcttcgccaaatttgtagaatcgatagatcgcctatgatagtcaaagcgcggcgccacccgtgagaactgagtctgctatttttctttcaccgcaatctgtggagatgaatatcaaggacggtgtgtagttaccatctaacagggatgaaatgacagctcacttgcatatgcaatgcgttgttcaacggcttaaagaagagaacacgaaaaaaaaaaaaaaaaaaaaaaacaaatcatccaacagagccatggttaatgacaaaaagataattcagccacaatatggagatggggagatcttctctctcttctctttggtccgtgtcggtgctggtcccagttgatcgaagatgattgctggctcgatcggcaatttcctcgatcggtggggacaaaagtagatagttcaggtacaatcgcgtttttaaatattttattgtcctcttagattcctcgctgcgtccatctttcgtgctaataaactcaaaatgtggttcttttctctcttttgttgtacgtgttttcgtttatatgtacggagtaggcttagggctagtcgttgctgtcttttctccccttaccctataatgtgtccctggcgccacgtcaattaattcttttctttttctattaattattaatattcgtgtattccctccgtctatattgatttcgcgcgcgaaccgtatgactaacagggatatgtgaaagacgtgctggtcttaccataaccaaggacgtttctctacggagaatcaattggatttcgcttaagtcaagatgcggtggtctttgctgttcaccttaatagtgtccctgttcctactggggacattggcagcgccgacttcaagcccgacacgacgcgatattggaggcgccaaccttgaagctagacaggaaaatgaaacggatcctacaacggagaatgctaccgaggctacaaccgcaagtcaaacagatgcatcaaaaacagctaccgatgcatctacagctaccgaagctacagcgacagatgctactgcctcgactaccagctcgaccgctgctacaaccaatgccacaaccaatgctacgacgacgacttctgctgcttctgctacctcgactgttccctcgctcgatggaacaactccctcttctcagcagcaaaccgcaaatccctctagaccaacctactctggcggcctgccaatcaaaccgacaatcacgccggcatggggtgttgggggatttatattaatagcactgggggctgttctgactttcattggtgtccgcaaacaatggtattcaatcttcgactcttggatgctaatatcttttgctaacaaaagaaaagggtccaaatcttcctctcgactgcattccttagcgctctgggagttaccgtgagttctatacctggaaagtagtaaagaacggaactaaccaatccccatacaggtcctcattatctatgtaatgagcccaccggtcagcaacgccgtgcagggtggctatctcgtcgccgccttcttcaccggcgctgtgttcggcggcctatcgctcgtcttcagagaaatctgcgagggactgggctgccttctgggcggtttctgtctgagcatgtggctcctttccttgaaatccggcggtcttctaaccgagggcgggcccaaggccggcatgatcattgcctttactgtgggattgtactccctatcattcagccactatacacggccctacgggctgatcggatgcacgtcgttcgccggtgcaactgccctggttcttgggatcgattgctacagcagagctggcctgaaagagttctggttatatatttggggtaagtctaactttttcttttgggttccatactgctcctagttgttgacgaacctaggattgaaccaaaacgccttcccccttcgaacggacacctatcccgttacacgcggtattcgtgttgagctagccgcgactattattattgctgttctcggggtgatctcccaggtcagactctggaatctcatcaaggagcgcagagccaaggaagaaaatgcccgccgggaacgcacccgaaagatcgaagaagaagatgccgaagtcggtcgccgcctcgaggagaagaacatccaagagcgcgctgaatgggaactcatttacggaaacggaaacggaaagcctgatagcaagactgtctcggtttcggagactgctgtcggtgactcccgacgggggtcggatgggttcgagtcatctgagaacggcaaggagggtgatatcgagctgaaggaaattccgagcccagatgcttctggcagcgaaaagaaccgtcagggtgaaaacgatgctcgtgaactcgaggctgtgccggaggaggattcatcccagcagggtcagtcacgggatgcagatgaggaaaagggcgccgagaaggagcgtcaatgtgaaggaaagaccccgagacctattacacctgttattactcatgtccttggtgagggcaatgatgactcctctgagcacggtgctgaaatcggctcggaggttggtacgccgcgctccaaacggttttctggcagagaaatgttgaaccggctctcttggcggaacagcaacggcgtggtgatagtttcacagtctcaggagaatctggtggctcatgatgatgccagttcttctgtacggggagttgtggatgatctccatgaggtgagcgttggttgtccgagtgttatctcggatgcggaggtccacgaccatgggcaaacgcaaaaagaaattaaggccgagctagctccagagaaggactctgcggatgcggaggttaagtcaaatgttggttcaccagacgtccaaaatgctggactccgtgtggatacggccacagcgcaaacagagaccgagaaagtgatcaccgaagaaaccactgtcagtcagcctattcaacaggtgtctcccgtcgagagcactgttattgccgacagtccgtttgagaattctggcatttccgaagtgtcagagaagccccaatcaccggaaacccccgcaacagatgttcaaggagaggaagtcaagtccacagctacattgcagccgtcacctttgaacgatactgaagggggaaaggtgaacgaggccaatgaagatctacctcctactactaaaaccgttaaatccgagtctatccctgaatcgaaagttgtatctttgcccgagcccaaggttgagccagagatcaaagtgctcaggaaactggatgcatcaaccgtgaaatgcatacctgagcaaacatcacgagtgattcactcgtaccgcacaaacgaatgggccaagcatctcgcagatgctgacactcctgagatggagccaattgagttcgaacccgaaccggaggcagaagactcagaagaagttcgcgagactgcagcatttgttgatgtaggcagtcttctccagacgcctcttaccgcacaaccaccaccaatcgtgaacagatctgaatttgatgatacggaaaatcaagaatctgcctacgtctcaccgttgccctcgccggatattccccgatccaagacgcggacaggcacccaaggtctcaccaatgcgaatccaactttaagccggaacaactcgacagtttcagtcaacatgcttcggtcatcttctggccctcttccaactcaggaaccggggttgccatcgatgcgcagcacgtcgactcccctgttgacaatcactactcccaacgagcccaaagaaacagtgccatcaccacgctggaacggaccacctcctctcctcgcagtccgccagaacatggtccgaaaccgcatgtcgtcgacatcagaccgcttcgatccctgggccgcacggaacatatcccgccaatccctacctgaaatggcgcacctcgtctccccaatttcaccaccgctctccatccccgaagaaacggacacagaacatgaacaagcccaacccaacgacgacgacattccactttccaagcggcgtgcactgctacaacgccagactgtgcagtccccatctgcattaacactggacaacctcgaggctgcccaattccctggatacttccagccagctcccgccgagctgaaccggtctgcatcaagaatggcagcatggcgacaatcggtccgcgaagatatcacccaaaaaagagatcctttggccatccagtcccagcctctcagcccggtcagtccccccgaccagcggcgcagtacatggaactctgtgcagcagatgcgcgacgcctcgtctattcagctgggcgatgccattgcagacggcatgcagcgtggcaacatgacggatctacaccgtcaggcaatgcggcggatgcaggcttcggcgaatcgaaagctgtagtgcccaaggatggcccattgattttactcgataccctttgctttgtgtgtttttgttgttattacataccatggcgaatgtgcctttcccacgactttatgaagtatctattgcatccatgtctataacctctatttgataatgtatatttttatatttttatacttttacccagtgcctacacaagctccatgcagcaagtaagacggctatcccgagcacagccgagacctggactgaaatgaaatgcagttcgtcattgtacaataaagcaatagtacgtctattagcgtttgctagaggcatactatacccaataaaagccgagatgaaacaagggacggtggattaatcacagtgaaactggggggcaaacggctcgcatatatattattggattggatgtatccctttcgagtctctgttgatataagatgtaaggtcctttttcaccagtttcctattcctgttgaatatttagaatgtcgagattatatacgccaagcaagcttctataaggatttatcaggatttcatctcgaatttcgccaattcaaatccaacgtctttcttttcccctaattcttttctaattctatttcttacactcgtttattgcatgtcctccacatagggcactttttccttggccgatctccccatctccgctttctcccccatctcctttctcccctcaaaacggcgtccttaaaattccccagacctctaagggaggaagaaacacactgttacccacaacaattcctaacggggccatcaaccaatcgcgcccccgtggagtcaactccgtcgtttgttcgcgcccagcggcgacagtgcgtcccgatctctggcccgccgtcgcttctccgcccaccagcagtccggctcgcaaacccagtcaactacgtcccacgaataaccccaataaccgtccgcccgcaccaatccgacgaaagcctcccactaggcttcggccactcacgcgacgcccatcccctcctcagcgtcccagagcgacgccgcagccgcctaaccccatccccgagcagcctactcgtcgagcgcagccagggggaaacagaaagtggccggactagcattgccctaccgcgacgacaccgccgcagcgaagaattcaacgaaatggccgccgcgttcgcgggcagcgcagcgcgcgatacggagaacctgcgtcctcccgaagctgtccacctcacgcaaaacggcactcgtcagaatgatcgcccccgccacgcccagtcacagacttccctccgctcccagtctcagattgcctccgttccctcgcataccggtcagccgcaggcggatgttgcggaggagcttgcttggggcccggctcatccttgcttcccgcatgttaatccccatgtgcctgtcgggtcgagggagcatatgacaacgcgggtgattcgcatccggcgcgactggatgattaagggtgatttggcgccgacgttttcgaatctgtatcctgagattctggatccattgttgtcggagcaggagttccgtcgggtgatttctaccgtcaatgatggtattatcaaggcgtttgatccgttcagttttcggaattggttcgatggcgcggtggggttgttgactggttgggtatgggatgatctcaatggtcccgcgacgaaaagccagctgcagcatgttgaggcctggttggagaattggaatcgtgaggtcggtgctaaggatggtgttcatatctggagcttgagacggacggcgtacatgtcgcttgatatccagattcccgatccaaaggttggcatcgtacccagtgaggcaccttcggctcctaataccaggccgagtactggtattggggctgggtcttgatggggtctgtcgggctggagtacgccgttttgcttttgctttctgattgttacatctttctgatttgttcccttcctgggacctctgcatgatatccatcccgcggcagattttttttttgacaatctttccttatataccttcgtctttggaggttcttttaatctttttgtgatctaatatctttcttttacatttcttctgtcagctttgtctacatatccctcttgatcctaggggctactttaccctgatttcttattgtcatcttcactatgccttcgtgtccatatctggctgtaacactgcattctcatagacttgctaccattctggaaaagaattacatcgtggcttttctttctctcttcaatactcacattgctaaatcaacacgcttatcacgctaaccacatacggcttagagcctctggagggagcctctggagcctcatcgtccgtccatttacactttcacgtattctcaacttcccctgtgcatacatgcacttgcgaaattgatttcatctacttccccgtaatggcgctgaggattgattgggtaccttttcttatatcatacgtttcaaatcggttctctttttatacaatattagtattactatattatccatggatactagtattccacacgacggcaatcgggggtaggcttccgtataacctatagaatagctttcttgagtcagtgttccttcggtcacaaaaccccagctagctttagaatagcgaaactgatgcctcatgctatcacagtgaaatccttgaaacttcacgagtgtagtacgatctttaacatcggatattttgcaactcggacccatcgccctgctcccagggatgttcctgctccaccgataggatcagcttttcatgcgcagcactccggggcgtaatctgtagcttgaattgcaccggatggctgataaccccaggctggaattctggttttacatccacctcagcaccgtcttccacgggtttgctgattttaaacaccgacagggactttgcaacactgagccatactgtgttgtctgccaaaatccggcctgggcagacacgacgcccaaagccgaatacgaaggtgtgcgggtcgagttctgggtctcggccatcaatctccagaaaacggtctggcttgaaggccatcggatcgtggtacagcgcggggtcatgcatcatgcccctattgtgcaggttagaatattgatcctataaacgagaccatggaaggccgattcatcgcacatggcaactcaccaaatattcggcataagtatagaacctttgggaatataatatccatcgtacatgtcgtcggtcgtcgacatatgtgggatccccatcggcagtgcagggtgccaacggaagacctcctttaccactgcattaacataaggcatgcgatcacgatctgctatcgtgggaagttgaccagggccgatcacccggtcaatttcatcctgtgcattatgttgcacatccgggttcaatgccatggcgaggaaaaacgtcccaactgaagacacggtctattacatgtcagcggcagtatcagttataaggacgcaggggagtatcatacagtgtcggcgcccgcgccataaagcgatgctgttgtccacctagcaaccagttcctcctctgatccagaagatggaatcccatttaacctaaatatatcggagaggaatgatggctcgtactttccatcttctgtccgctgctgaacaagtgcgtaaggctttttcgcgacatcctcaaggttctttctatattcctgcgcggttcgcttgaaaccagcgcccggaaaccaggcagggacgtatttcactattggaatcagcttttatggtaaacagataagagggaaaatggtaaagcgcaacttacatgccggtatcaaatctacaagccaagtacctggtgttgaagcaattgagaattgctcaagggcctcgttggcaaggttcaccagtagatcttggttgtgcggctcaaccctatagccataggctatcctgagaataaccgctccggcctcactgcttaatcatgttattatctatatcctttttttggggcactgggagtattgggggaatcactgacgtctggatgtgctccgtgagttttccttggtctttcaaaacacgccacagaaagcgatcggtttccacctcttgcagccgagcatactgtgagatggccagctctgaaccaaaatatggttttagaagcttccgatatgctttaaaccgttgggtgtatggttgcatagataacgcatggccccaaccaaccctgttaagctgttaatataagctccaatagtctatttgttctagacttaaaattggaaagggatttgtgaaattacatttcagatgcgaaaaccatatgcggtcgtgacgagtacagagaggcgcgtttgcgtaacagctctgacgctgtccgtgtatcattaaggattacgagcgtctgtcccatcaccgtaacggaactgatgggccctacaggcgccttttcatattagcaacaagaaaagcaagacaacagtcaaccgtagcttcttgagcctaccatataggtctttgtgctttagccaatgcatccaatcttgcacacctggaggcggcaggtcggcgatgttacccacgattggcttaggctgtgggcctgggggcagtggccctagaggtgttttgcgtctcatccatatcctcgcgataagaaaagcgagtagtcccagtatagcgctcaagagtgccttgaacgacatgttgacaggccacaaaatgtaagtgtggtaatcggagaaagaaaaatgaaagtcctaatcgcacttgagtacgggcccacttgtggctgctttactcatattactccgtagtctctggtgcttttagccttctgcatcacgcggcgctcatgcaccccaaggctgtactttcgctgaggaccccgccgttcaatgctcgctgaacgaaccacaagcctccaatatctgctatgcatccccgaaaggcctcgaccccttttcgaaggccgtgaggcgaacggatctggtaccgtcaaaaaataacgctagaccgcatttacccctgacgaatatgacagcttagcgaaagcaaacttatgggggcaatgatctgcgaagatgtcaacaaataaatgctcaatcatcggttttttcccccttcggctataagaccagctgacgctagagtagcaagatactccacatgcattcgatgtcatggcagcccttgcccaggtgaagggtaagactccataaaagacgcttacggattccaaagccggttgccccaggcgtttttattggttggctttgcttgacccacccgtggtgaaccaaggggacggcaatgcagaaacatggtggggcctctgatccttctgtgttggcgatggtcgcgcatgccgcagctggccatgtgggagccacacggctgggacgcattgttgatgtcatggtcaggacgcatctatagagtattgcctcttgaaaggtcgaggtttattggtattcattatgttgtatgcgcccacttggacttttctacaacctgtgctaaattttctaccctaatcagcgctcatatcatgtttgctttctggaggatgggttaggcgcatgccttctgcgattacatgccagttatattaccacttacgaggatatcacctcgtggaagttcgtcataattggacccgatactatggcacatgcacatgccaatatagtgcatcgaatgactggggcgcacgcttgttcagttgctacatagtgtgatcaatgctaagactagtgttgataggttgcgctcgagagccccacttctgcacggacttcactggacaagaggcctagcgtggcatggagagagtctttggcttttcttccgatccacagacccttgttgtatatacaacatagtctgagaactcggctccaattgctattggcgatttctccagttctggtgaactatttctgagcccctatatcctacctgcatctcatctgtgacttttcaaagcaaaccctcaagcgggcttggtcaagttggtgcctggagtacaattcacgggatttgttaggtgtgaacacgagaaccagaaccccgaggtccggtcaaaatcctggaattaaatctaggcactcttagcgtatgtgccaagaaacggggctttcgtgtattccaagtagtgccagagaaggatcacggcattcgtctcaccatttacgagtacgaggttcacccagatgtaacttagccccatgagtctggacatatcttccgtgctccaatcttaacacttacattttcccggccgcgccactacacgctggacctacagatcattatgcgatcccaatcccaaatttcggagtacgttgctttctcagtccggagtatatattattctatactgacaccaatcagaaacaagggttctattggacataacgtgcccatacttagcgtgtcgcttgaaaccgagaatggctccagagaactgaagcgagaaaacggcgatataagcatgaattttcgatacaaagtgacatatcacggtgtcgatactatcaattctaccactgccggtcctcttactttctgcactagtgtcttccatgacgaattgaattatcaattagatcgacgggttcagagtggcagcgaacagtggattccctgtagatatagtggttattgtcccggttttgtgaatgatcaaccttctaagattcatgttgctcaaagtgaaggcttcgtatgtctctatccaggtgaaagctgggaagggtcattcaccttggatgatgagctctgggagttcccagatcatctcagaactggggcgatcttccgatttgtattcaagggcgcaacgattgagtggtgggattggggcactaaagctgggacccatgctgatactgtcgtgactttcaggggatatggtcgaagtacgaggtcggactttacagatgataataatggtggcagacctcaaatatttgttccctcttccagcgagatagagctagttctcgcagattaaaccgctattattgttatgtctctgggaatacatatgtaaataaatattgctatgaatctttttccagcagaaacgaaagccaaaaaaaccccagggatcgtaaaatagcataattgaaacttgagactcattcaacaagggctccctttcccctgatagagaatgagttctgccattagtacgtctccaagtaatataccaaagcatcgcctggccaatggaaaatgcgagataatccacagctggccatccgatctgccgataccattccacaagagaatcaaagaacgcggggatgcggctcgatggccacaggacccgaaagaaccatgatgcaccaagaagaacgaagacaacagcttgagtggcaagtgtgcgaacactcaaacaaaacgattccccttgtaaactgtgacgagtttgaatgatagatgatgcaatgattgaaaatgtcaggccgggaacctgttaagatttaccctgctaccctgcgagtatggcattcacccaaagtttcaatagagtgaaatagcccacttcaagatttgaaagtacaatccattgcagttcaagttgacccttttcatgcctcaggcggtgtcgatccaaccccacccctgtttccgcagctctccaactccaatccccaggaacaactcgactcacccacaacaatatgctctcggggatcctcatattcaatcaaaagggcgaaaacctcatttttcgtgccttccgcagcgattgtcgtccgcgcctggccgacatcttccgcattcaagtcatctccaatccccaggtgcgctcgccgatcctgaccttgggctcgacgacctttagccatgtgaagcatgagaacatttacttggtagctgtgaccaagagcaatgcaaatgccgcgctggttttcgagttcctctaccggctggtcatgctgggcaagagctatttcgggaagctcgacgaggaggcagtgaagaataacttcgtcctgatttacgaactactcgacggtgagacatggaaaaggaccaatggcctagaagcagaccctaacaattgatacagaaatcctcgacttcggatacccccagaacaccgatccagataccctgaaaatgtacattaccaccgaaggcgtcaaatccgccatcgccaactccccaaccgactcctcccgaatcacccaacaagcaacaggcgcgatctcctggcgccgctccgacataaaataccgcaaaaacgaagccttcgtcgacgtaatcgaagacgtcaacctcctgatgtccgcaacaggcaccgtcctccgcgccgacgtcaacggccagatcgtcatgcgcgcctatctatccggcacacccgaatgcaaattcggcctaaacgaccgtctcctcctcgacaccggcgagtcctccagcaacatgaacaacccgggcggcggcaacggactcagcacgtcaaagaccacgcgcgccgcggcaggctccgtcacgctggaagactgccagttccaccagtgcgtgaaactgggccggtttgacgcagaccgcatcatctccttcgtgccgccggacggcgagttcgagctgatgcgctaccgcgccaccgagaacgtcaatctgcccttcaaggtgcatccgattgtgcgcgagatcggtaccacaaaggtcgaatatagcgtcgctatcaaggcgaattatagctccaagctcttcgctacgaatgtcgttattcgcatccccacgccgcttaatacggccaagactacggagcgcacgagccagggtcgcgccaagtacgaacccgagcagaataatattgtctggaagattgcgcgcttctcagggcagtcggagtatgtgcttaatgctgaggcgacgcttacgactatgacgcatcagaaggcttggagtcggccgccgttgagtctttcgtttagtttgcttatgtttacctcttctggtttactggtgcgttatcttaaggtctttgagaagagtaactatagctctgtcaaatgggtgcgttacatgactcgcgccgggagctatgagattcggtatgtgttctatctttcgcgttggctatggattttttttattttatttttcgctgactcaattgtttcattcagattctgatcgttcctaaaattctgaggtgattttggttgggagagaatcccaacgagcagtgttgatatcaatggacttgagtccggtttcatcttgtcatttttactttgcgcagcacaattggtgtctggcgttggatggacatatacatggatttttcacaagtatccaattctgcatttcccgtaccttgaataaatgcttgtatgcaggtttgaggttgtataatagcatgtttcactcagctgtaggtgtatctagccccttgtggtatccatggggctagataaaagtttggctctaccaactgacccttgggaagagagctggagagaaaacaataacatacgatgagacgaatgtaacactacatagccactatcttgaagttggagtaatagacaatggaaaataagtcatgttggtagtagtatgtagatagtagtacaattggaacaaacgacagatgtggaagagtaagtgacacaataagaacagtatatgagcaggaaaacaagaagcatattcacatagcccgagtagaacggaactcacaacaccaaaaagcagaaacaatttgtgctggtcaagaaaaccgaaacgaaaatgaacagtctcacaaagacaagaaggtatgataatacaggggtgtttgacaaagaaatcaagccaagtcaggccaataggaacagggtcagtcacaggatacaggtacagagatcatataatacattaataaaagacggtaataattgcaatagcaatgttcaacaccgacgcggacgcaggccaacacgaccctcactaaggagggacagccacctggacccgacatggctgcgacccatttggcgcgcgcactcgtcccattcttgttgggagaggcggaatttctcgaggaccagctcgagaagacgctcgtcttcttcggcggtccagtcttgtggagccgaagggatatgttcatctgttacctcgatggagggcagaggcgtgtctgggtcgggtgagccagctgggatgtcatagtccacgcggcgacgaggcggagatggaggagattgggtgacaggaggagaatgtagagagtaaaagtctgtagaggaaaggccgagaggcatattgtagggaatgtgacggcggcgcttgggagtcgcgaagcggttgcgccgacctatttccgcgtcgctgtcatcgtcgtcgaggatgtcgcggcggcgcttgtttgcgccgcgggcgggtgcggatggagggggagggggtgtgagagcggcagttctgggtggtggtgtttgtctgggagagacgggtcggacggtcttgtgtgatcgtggcgagcgacggggtgtgttgaaggggatggggctctggagacgttgggatttcactgatcgcgatgaaggtgtgggcgatctgttgaggagagattgtagtgcgcgacaggtgccgaggagaccgttgcccgatggaaatcctgtgtcggatgggggaggcgctgaaaataggcgactaggggtgaagcgagacgaccggcgcacatcgcatgggagggcggatggaagtagcatagttgtagatataaatttaatgcgcgacttgagtggtttgaagttggtttgaagatgaatggtatcaaagagagagagagtcaaccagttgttgcgcgggcgcgcgatttgtgggtaggctgtgttgcgccggaggcggtttcgatgcgcgacgagggagttggggatgcgaaaacgaatgaattaacttgtcgttgaaatgcgcttcgatttccaccttttccgggtgatgcgacagcgtggtgatataaaagagttttggcagcgagtgtgtaggggagaagaagttggaggggaaatgcgataaaagaaaattggggccgcaaacgggtgatcgtgcaacgtcaagtttatttccggtcacaaagaatgtgtttctattaatgaatttcaggttcaaggttcttttttgatgaaacagttcaaagacttgaaacagttggaaacaattaaaaaaagaagggatttgagagagatatctcaagggtcaacgaaagtgagagtgatgataggaaatactagatagggaacaggaatgcctttctattatactcgaactactgagtacttgatgaacttgcaactatagaccagtgaaacagtatactaaggagtctaggataagagggactatatgcaaggcgcatacaaagagagccctggagagggcaacaggcacgaggcacccctgagacactttttttcaattacatttcctattcgggcaacagccctgaagatcccctgcactcgagtttctttgaatttcaatgtatccggagtagtagatctggattggattgtattgcaatggaattagagcctgtaacgtcaatggcgtcgggctgcataggcatcaaagcgcagccctgttagacgcgctaggtcatacctagctacgatattctttgatttcctgatctccatcttcgccactgggggaagtcgcgttttaataatgatttgaaagagggtgaagttcccttcctactgttctcctacccttcttctacccttcaccagcccaggagatgtgttccctgccataccagccctctagggctctaggactatagcaccttcaaacactgctacttgtatgaacctactcttagaccttgtagatatcttcgtgaaatggtactccgtagaatggtggctttcaaaaattccaacgcgttaacgcgtctcgcgttttcgcgtcacgcgacgtgccgcgccaagactcttggggcacacatgccctaacaacgtattgtatggacgacactacggagtataccaatggagtacagtatgtatgtgaataaagagtactgcagtgctgctcgtgggtcaatgcttagaatgccatgtgcccaataggatcaaccaggctcatcccaccgggggattttctatactgtactgtaagaaactctgaccacccttgcttccccttacagggtcactcaggccaactcgtgcaaagatacggcttgcattatcttgcagagctctgcatctaccacactgtggggtgcagactggctgcacactacgggccgacaagtcctctacaggtctataacacatagactcattgctccactcattacagagtactacgatgtacatacagttggtaaatgatattccattcgtgtcaattgaaaaagggtggctgctccttcgaacccagcttaactagaagggctagcagggccactattcaaacggccctagtcctatctacaataccgagtggagagccttcggagtactctaagcctccattccaagacccgtgctcccagccacagatcaaaatccaatctcatgcaaggggtagcccgaggatgaaactgctcccaccaagaatcattaattatcacaaggttaggcttctgggacttaggacacagagaggcaagtcatcaataacacaacgcaataaacacaaaacctagaatggatgaaagttttccaatttccagggttctctcctactaggtaccgagatatctacggatgctatctaagcttctcctgcagtggcggtaatgcaagacataagccccttcccacggtccctaatgtcgatcatacctccacattcttctgatctgttcgtgccctaatgtggctgggagtctacttgcccctccaggcccccgccttggagcttataggacaagatacaaggtttcacaggttcaccttgatggcctcatcgtctcagacatagctcaatatagatcccttggtagttctcttgccccatcactctctccctgtcttactttctggcccaacatgtgtgcttcccctggcgatcattcctctagattcccggtcttgttaccccatacactatcgcttttcttttcttttttggttgcgaatagacaccattgcgcagcagaccggatgatgtgtctcggtgtaggggctgtgtagataggtaccggaacccttgtaaaagagggcctatagaattagaattctaattcatgtaccaagcttttctagcatatccatagcaatgaaagaagaggcctgcctcacaacactcgagtctaccacacttgcaaaccgaggccatctacttcgtgtcatgtgcacttccccatcgctcaaccactcattggcctgaaagtgagaccatctctccagttttgctcccgatcagcactccctatctctgtattgagctcccctcctccccctcttctgttatccccctgctctactttcacagtcacacgataaggacccgctatcctttttggtggctactaaccctacccgagacacagggataagaacaaagaggctaccaaaatagaagtgggctcactacactggaccctggcctcttactgcccaatggtcagtggaagcccctctatccttgtctggtggtcctagtaagcgctattgttgccttcgtgcgccccctcctgtccctctgtgggtcgtggcccgtatgtgcccgaaggaccaagaactatcgcctgcgtaacttgcttcctagggatggccattcagtggcgattaagtgacgtttcgttctgctgaggatcatcgccagtgacactggtcttattagctcccaaacctttgatactgtttgatgcttgcttggaaatagggaactcctgggcttattgctgcgtaagcaatagcgaggaagagaaatagattctaaacatgagtaatattttccttgccccgtggcaagcccagagccaatgtctacttagaaatataatattcacggcgatagtcacgccgccaaaacttcaatgcttaaagggtatacaaacaaaacctcattgaccctgcattctcttgaaacgctcctctgcagctctcgctctgcgctctctctccagtcgcatcttcatctccggcgtcatgcctctagtctcctcatctctcctttcggccgcagacttctcaacagcgcctacagtacgaccgccggatttagtcgttctcggctgcgctgccttctcggcctcttcgcgtttcagacgatccaagctagccttgcgccgggcggcttcttcctcctcggcggttttgcgttctttctcagctcggctttcggcctcggctttagagaccgctgacggaaccttggctgcttcccagtcccattgtgactcgccaagctcgtggcgggcaatgcggaaggcgtcgcgcgtggctcggtcgccggtgagttcgaatggggttctgccttcgttgttggttgccgttgggtcagaccgggcttttgtgaggagggccgtgactacggctggtgcattgagatttgctgcaaggtggagcggggtggggcagcggaagttttgtggcgagtcggcaggcgtaaaggtgaaagaagaaggtatggagttgtttgagatataggacatgagggcgggaacctttgagcggcgaatgagtgcctgcagttgggatgtgtgcaacaacgcagcttcctcttcttttgagagtttcggtttctgtggttgcggttttgggacaggggtagatggttttgattcctgctctcgccgcttggcttcagccgcagccagtgcggcttcatccacctcgctgaccttcattcgggtcaactctttgaaggaccgcatgagctccccttgagtcgcacggcgagtattgaaggggaaaccccgtagtcgggggtcgttctgtctgaggacctgtccgtcatattgaccgaaaagagtctttcgatttgtctttcccgtggctcggacgaacaacagctcggctgtatcaatcattcctttccaatccgacaaaacctctctgatatccttctcaagtgcagcctcgttgtaccgacgcaaacttgaacctgctgaatgggcagcaccccgtgacgcatcactggcagactgcgaaccaccctgctttcgccgcgtcgtgtatcggtggaacgttttgtgcgcaatgactcgagcctgtctgtcttcaactcctccttgctttcggtggatctctggtgctagcgaaaccaacatagccgcaaagtggccaccgccgatcatgcacatgaaaatgtgcgggccagaagcagcggggtcttgcacgttgcttgccttgttggtgcgcgccttgataggcgccagctgcttccgtcgtagagtatcaactaggtgagcgggttcgtcctgctcctcatttgagaaaatagccctgtatacacctagggacttgtttgatggcaatcccgagctagacagccagaatatgggatgcttcggagtgatcggtgtctcggtcatttccggatcctcgttcgggtgagacagcttggcctgctttttcagcagggtggacagcgctgtgctcgcggcctcctctgaatcctcctcctctgtctccgaggactcagaaccggatatagactcatctagctctccgattgcctttgcaaactcgatttcctccagcggcgcattcccgcgcagctgggctttgatgttataccggtgatggtccgaacggacatggctgcgttgttcctgtacactgttgtaagacaccctgcagagggagcataggttggacgttgcgatcgcggagtcctgtgccgctagttcgaggtctttcgaagagggttcggggtcttgttcggcgataggttggcttgtggtcttggccgttaggctagcaagaagttctggcggcagatcgtaaactggaaagatcagcggattgaatcaaagacgatatggggtttcggaggcgtaccatatagaggccttttcaagagctcctccatctgagtcgtgtcgaccatgatgggctgggcgaagaatgtgtattgagatcgtggtgcccctccaatgacgctgataagtgggctcttaccgcctaagagcaatgccgggtagttatgtggactttatgagcttcgtcgcgttaactatgtctatgctgtagatgctgaatttgcaatgcttttgagtcatattatgaaactttactcagccccttttgcgtcctcgagaatgttctttttcctgtgagtaattccaagcttgctgtgccacaacgagtcggcctcccgattaggaaattacacccatccactcctgtattcttggtatgcattgcatttcacgtattagcgcatcatcctaacaagtactcctttctctagccatccttcaagtatctacgttgtttacgccttttgcctttcaagtaactgtcgtaatcacgtgactggagagcaagaggcaacattatgacgtatcttttacacttgccctaacttcaatgttgtttattcttcttttccttgcgatgttagtaaaagataacggctaattgggcgtcttgggctggttgcgcatcccgatggtttgaatcaaagatagtgattagattgaatacttttaaagtcagaagtaatactacagtatgtgtacagtatgtgtacaatatgcgaaggatggttcatatagacatgaagactggccactaatctgaggtcatgaatacttgcattgcttggatatatttatatgatatctacatcgtatgttatacaactatttactttatttgccttccagtatgcagcttccagtgtttcgggagatagcctaaacggagacctcaagatgcatggtgggatgcaaatccaagttgaagagttgacgaagttatgttataggcacaaaaccaatggtgaatatcagcaatacctaagaatggatcctaggcaggttgtcgtaaccaccatgtcgctagccaatgtctcgtcggtaagtgccccaagaagcttcaatttgcgggagccagaagtcttggtaggtaatcagctggtcctctacccacaaacgccaacgaccaatctggaggcccgtagatttcgggtcatatggtgtagtgagtctcgcgtaagaagggtcgatctccaaaatggctcttcctgcaattcctggctcctgactcgatgcctgccgagtcgtacgtgtataacccagaacgatgccaatgccaccagaaccgggaacaatgcttgttatcttttgcgcgagctcctggacacgcctttgatatctgagagtggtggaaattccaaagttttgtctatcccaatcagtcgtgaatggtgtgaggacgaagactttgggtgcgtaaattgcattcaagacaccggggttctggtcagtcccgatcaaaccagttacactttgtgcatattctgttccatctcggagggaattgaacgcatttatcgtgaacgagttgtcatcagttggattggaaccatgatcaacgaatacggggttttcccagatatgagcaatgtacacacctttctcggatactacgagcacagccgtgcatccgtatacaccctttacccctatagctgagggaatagatgatggatattcaaaccattgggcagacactggtccaagctggttaatccaaattggcgccaagctctggacataattgttgtaaaggggagaagcgtcccggaaggcacacccaatcaataaactgatcattctctcgtcttggctgctagagagactcgtcttgggggcaaactgcgttggacttgcgactccactccttattgcaatttcatggctcttagtcgattgaatagtggtgataccctctgagatcaatgcacaatgctcaattgtggccatcactccgatgttggcgctgcccagagggcctatgctcacgcagcttggcttttggtaagtatcagaaggacatagtatttgatatcacttgttgaggtgaagctggaaactgtggttgttgattctgtgacggagtatccaatagtggtagcagtagctgtgggtgacaaggctgttgtgggaacagtgggattgtagagaattaatggtattgcttttgatattcgaacagtgtagcttccccgttcaatatctttggttctgatagaagaattggtgggcgagagactttgtacgggtaaaggggcaaggtgtgcttctgtgtcattgatacccaaagaggtaagtatgtgatggtgactaggctatcacattgaaagagctgtgcgcagcgctgctgaagacaatgacaacaaagcttgtttgcttgggcttagatacaataagattgtggacattgctaaacatcacctcctatcactaaaatccgataaacttttgcatttggtttatagtcagctcggtctttcttttggtaaagagtaagccgttaaattcaggaatggaaggtctctattttatagtcctgtcttcctagtaagattttggtccaaaggatgaggtcgattaaggagtaaagtaagactcaggttattcagagtgaaagaatggttaacgaattaatgtgtcgtttctcaaggcatgtaagtactccaattaactcatgattggcttttctcacacttgatctgtgagtacacattttcaaatgcgtttatataggctatcacatgactggcatcgcaaggcccatgcgtctctttggcatcaatctctcaactttggcaaaactcaatatataggagaccagagtctatcatcgctttgggcaacatgtcttcacaacagcagcgtcaacagcagctaatgcttgatgcacgccgccatcaaatacaaattatggctgctaagcaacaagcaaacgccagaagcagtaacaacaacaacaagggcactccttcgcggcagcaaatgcagcctcagtcacggacaatgggatctaaatatgatgatctgcccatactggagcccgctgatgctgtcttcatcagtgaaaatcccgggtcggttggtctagttcccgccttcttcgtgccctttgaatccgcctgccagcacggcccgctctccatcattcagtgcatcgtgtcatctaataatctgacgcctgcttttcttcaccatggtcttacacgtgccctacgctctggcaatattgaggttgctcattatctcctcgatcgtggctctcccattgttcgcgaaactccaagcaatatcttctgcgtacctttggaacgacaaattgccctctttgagcttcttacccagtatggatggactcccaacaccccaggttactatggtagtactcttctccctcggactgtcaagagcccccctcttcttcgttggtttctcgaccatggggccaatcccaaccttggcgtgcagaaaaccacccatgacaggtttggtggaccagatacttcatcgtgtgctgcactcgaggcagctgcaattcatggaggggttgagtcggtgtgtatgcttttagacgcaggtgctaagattcaaaacggcgtaccactacactatgctgcaggggtttgtcctcccggtacgaatccacatgctgggcatgtagtcccaagccgggaattcgataccagcaggattccagtaatggagctactggttgctcgtggggctgatgttaatcagaaagaagagtcccgacacatggtcgcacagtacgcgattgtgtatgcagtcatggcaggagcagttgagcgggttaagtggttgttagagcatgaggcagatccatataaaataggaagctggggtagtgcagccgagtatgcacatacctcggggaatgaagagatatcaaaggtcattggggaatttgctaaaggcaatgattgatgtctaaaagtatagcccataccaagaaatatatattgtgctatcccggttcggaaatttgttacttgtggcatataaaggatacggatttttttacgttattactagtatataaataaataaacgatgaacacatccatgttgaccagcattataaacggctctcgaagccatcaagccttctccagacttcccaagttgaaatccaacgccgataagaaatagccgcatcggtcttagtgcgcttatccccgaggattacatcatttcggatcacgtgaaaatgtcttggaaaattcgtattcggacatgaggtgagtcaggaagacatacctacctaggtacataggctgttaattcatgttacgcaagtctcatgcaagaactccagacaaccctgcctccatgtgtacaagtacagtgtaattaattaattagcctgacttcgaatacgaatgagtatggtaagcagccccgacttcgggaatttccccgtaaagtggagctgcccgttcttgcttttgtcagcagcctagcttgcaccaacaccccattctttcctcgtggtacttctccaacgttgtatcttttcttgcctgtgcacagaaaggcatactgggacgaagtcactaagaaaaatgctggatggccaatcccaggtggtcctggaggcgtcccgcccggggcacctcttacattcccttggatcggcgcttgattcccggcgacagcctttctgcacagatagcgagggctggggccctctcagctcatcgagattcgatctgacgccatgcttccttgacgtgattgtggctgtagtagctgtctggggtacactgagcggactgggcgccttgtggttgttactgaggaagcggattccgcagcccgtatcgaagaattggcacttctataccaagttggttagtacatgccgggcacccccgcgcaccttcgcacctccttggacgtcattgataatgtactgactactggtattttgttcataggctgttctcgccgctctcatcgttgttaccgcccttcaagctgcgatccaggtcgaatcagaccccaaaagcttctgggccgattttcgcttctgggcttccatcctgacaattgtttcgctgggggtgataacctcagtgcaatatttggaacattggcggagtagacagcccaatggggttgtcctattttactggcttttcttcatcatcgcctacgccgtcaaactccggtccctggtcgcgcgcaaggaatatatcggccgacttccttactttgtctgtttcaatatcagcttgggactagcactctttgaatttatgctagaatatttcgtgcccaagaagcaaagcgcctacgatgcgctcggagacgaggacgagtgtccctacaattatgctgatgttttctcggttctcactttcagttggatgactccgatgatgaaatatggatacaaaaactacttgacccaggacgacctctggaacctccgcagacgcgataccacccgggtcacgggcaatgccctacaggaggcgtgggatgaacagctcgaaaaggcaaagccatctctgtggacagcgctcttcaaggctttcggtgcaccctatgtgcgtggtgcgataatcaaattcggaagcgatatccttgcatttgtgcaaccgcaacttctacgacttctcattgccttcattcactcgtatggaagcccggacccgcagcctgtcatcaggggtgtcgtcatcgccttgtcaatgtttgttgtttctgtctgccagacaagtttcctccatcaatatttccagcgtgcttttgacactggcatgagagtcaaatcagccttgactgctatgatttatgccaagtcgctgaaactatcaaacgaagggcgctcggcaaagacgacaggtgatattgtcaatcacatggcggttgaccagcagcgcgttgcagatctgacccagttcggcactcagctaatctctgcgcctttccaaatcaccctgtgtatgctctccctttaccaacttcttggaccgagcatgtttgctggtatcggagtcatgattttcatgattcctttgaacggtgtcattgctcgaatgatgaagaagttgcagatcatccaaatgaagaacaaggattcgaggacccgattgatgactgagattctgaacaatatcaagagcatcaagctctacgcctggaacacggctttcatgaacaaactcagccatatcagaaatgatctcgagctgaacacgctccgcaaaattggcgccactcaatccattgccaacttcacctggcagtctacccctttcctcgtgtcctgctccacattcactgtcttcgtgttgacgaatgataaacctttgactactgagattgtgttccctgctttgacgctgttcaatttgctcacattcccgctttctatcttgcctatggtgattacagccgttattgaatcttctgtggcggtgacgcgattaatagagtatctaaccgcagaggagctgcagactgatgctgttgtcctccaagatcccgtggcgcaaatcggtgacgagtctgtccgtgtccgcgatgcctcgttcacttggaatcgtcatagcggggagactgtgctggaaaacatcgatctcagtgcacgcaaaggagagctcagctgtattgttggacgggttggcgctggaaaatcttctctcctacagtcattgctgggtgacctgtggaagaaccagggagaggtgattgtacgtggtcgaatcgcgtatgtcgcccaagcgccgtgggttatgaatgccagtgtccgagaaaacattgtctttggacaccgatgggacccatcattctatgatctcaccgttgaggcctgtgctttactcgacgactttaagaacttgcccgatggtgatcagaccgaagtcggagaacgtggcatttccctttcaggaggacaaaaggcacggttgacactcgccagagctgtgtatgctcgtgccgatatctatctcttggacgacattctctctgcggtcgatcagcatgttggacgtcacatcatcaatagagtactcggcaaaactggcctcctcagtggcaagaccagaattcttgcaacaaacgcaatcactgtactaaaggaggctgactttatcggcctgctgcgggacaagaccatcatcgagaaaggaacctatgaacaactgatggccatgaagggggagatttcgaatctcgttcgctctacgacagttgactcggacgatgagggtactgggagtggctcagatgacctagctagccccgacagctcagtcacaaccaccatcgttcaggacggtggtacatcggacagcgacgaggcggaacaacttggtgatcttattcccatcaagggaggagctggcgaggcccgtagacggacaagtaccgtcaccttgcgccgtgcaagcactgtgagctggcaaggtccccggcgcaagctgggagatgaggagaacgtcctcaagagcaagcagacccaagaagtcgcagagcaaggcaaggtgaaatggggtgtttacggtcaatacgcaaaggatagcaatatcgtggcagtcattgtttacttgcttgccttggtggcttctcagaccgctcaagtggtgggcaacttctggttgaagcgctggactgactggaacgaagcccatggaagcaatgctaaggttggaaagttcattggtgtctacttggcgcttggcctgggatcatccctcttggtcattgtgcagaacttgatcctgtggattttctgctctatcgaagcatcccgaaagcttcacgagcggatggcatttgctatcttccgctcccccatgagcttctttgaaaccacaccatctggccgcatcctcaaccgtttctctagcgacatttatcgagtcgatgaggtacttgctcgcactttcaatatgttgttcgcaaactctgcccgtgcggtgttcaccatgattgtcattgcgtcagccaccccgtacttcttgctattcgtcgttcctttgggttatatctaccttagctaccagaaatactacctgagtacctcacgggagttgaaacgtctggacagtgtcactcgaagcccaatctacgctcacttccaggaatctctgggcggtatctccaccatccgtgcctaccgacaggagaatcgattcgcccttgagaatgaatggcgcatggatgctaacctccgggcttacttcccatccatcagcgccaaccgctggcttgccgttcgactcgagttcattggttcaatcatcattcttgcatccgcgggacttgcaattatggccgttgcgactggcactgagatttcacccggcacggttggtttggccatgtcatatgctctgcagattacgcagtctctgaactggattgtccgccagactgtcgaggtggagaccaacatcgtgtcagttgagcgagttctcgagtacgctaatctcccgagtgaggcacccgacgtgatcttcaaacgtcgccctgccatcggctggccggctcaaggtgccgtggagttcaataactacagcacccgttatcgccctgggcttgaccttgtgctcaaggatgttagtctcaatatcaagcctaaggagaagatcggtgttgttggccgaacaggcgccggaaagagttcgctcacgctggctctcttccggattatcgagggcgtcgaaggaaacatcaggtaagaacataccactattacctttcgtctctgttctccaggctaacaaacatttagtattgatgggctcgatgtgtctacaatcgggttgactgatcttcgtggacgtcttgctatcatccctcaagatcccgctatgttcgaaggcactttgcgcgacaacttggatcctcgtcatgtgcacgatgacaccgagctttggagcgttataggttggtttcacttagatccatttaccgcggcgcccagtgactgacggtttgcaataaacagatcatgcgagattgaaggaccatgtctcgaggatggacggacaactggatgctcagattcaagaagggggtaagtgactatctgcgtctacatacagcctaaggcatcctgtcccctgacacattattgcaggctccaacttgagtcaaggccagcgccagctagtctctctcgcccgcgctcttttgactcctagtaatatccttgttctggacgaggcaacggtaagatagttctgtctctactttttggatgatagtttcagctaaccatggcgacaggctgcagttgacgtggagacagatgcgctgctgcagcgcaccctgcgcagcagcatcttctccgatcggacaattatcacgatcgcgcaccgcatcaacacaatcatcgattcagatcggattgtcgttctggacaaggggcgagtggctgaattcgacacgcctgcagagctgatcaagagcggcggcaaattctacgagcttgccaaggaggccggccttctcgacagcgacggtggcattatttcctcgcaatagccgtgaaaattcaatcgcttgcagcggcctcgaatccccgcatttcctgttcatggcaaaagagatcactcagccagcccacccgagttgaacaccgtccatgcagctctgagtggctcggggaagccgggttttcttttctttttggtacctcgggccgatcctaagaggtcccagatgctctttgctgcttgcatgggtcatgttgacagcagatccttcctgaccgttcaaatgtaactttgcggtgctgaatgtggcgccagtgtctgtgcatatatgcatgtacatgtactgaagaaaagtttttcattgcacagttcaggggacccccctgacagggatggacataaacggtgggagagtggctaaatggttgaatgtctgccttgatttcttttctttctttttaatatgctgccccgagccttgtttcatgttggagatggtttacctcgatgtatgaggacatccgattggattttgaccctgcgaactaaaagataaaagtgattccctttcgtacattaccttccttctttttggacattttgatcaaattgtggccgtgcactacatgtttatatgtggataacctgaagactaccgacatcattgtctagactcaagtgaacagctgaacaacgtaattgtacatcaaactaaacgaacagacagcattcccagactagaatcatcgtttacgatgattatctgcagtagtgtcttgtactaaacgtggcggtgacatcttgatatcccagagtaattcattgtagcggtgaaaggttggccacctgtccatcgtctactcggaggccttcgggtaaatataacaaattgtaagctctactccgtacttatctgtatgttgcagttattccgcgaggacatgaagctaagattgtcatcttcgacataataaaaccatgtacataggccctcctccacatggtttcccccttctctctggttcgacgatcacatcctgagaatatatctccggcaagaaaaaaatagatatgccaatttcaaacaggtatacgacactcctgcataacctccttactgcctgcaaaacagactctccacgcggttggaattatagtacatgcatgtatggagtaaattgttcaaataaggaacgactgtttcattgaagtacctggtacagttgtctgaaatatctcaacctgaaatatgttgtatatatatttcccgatgccaaaggtgttgagaggggcaaaaaggaggggcaatgacaagaagtggatttcgactttgatttgcacgtcagatgtttaatctacttccactgttaacaatttcgaaacacaagggatatcatctacaacatacgtatagggtgtctttctcgcgtctaaatctaacgatcgcatggcattaccttccatccttttcccattcatagaatctgattggctgtggacctgcgttcaggatatgtttcagctatccagatcccaggcaagggatgtggatgacctcaaaacacggctgcacgactgatctcgaatgtggacaccggaatcttgttcgatgggccatgtcttgatgaaccaaccagagagacagcaatcttgatcttgagatcgcgaactccccagggttgtgcacgtcgacaaaagaggcaatgttcacagaagtagatcgatctcgcacggactgcgatcagggtttcccggatagtaactcgactcgggggaagaatttgtgctttccaagcgaattcgtttcaatttgtcttgctactttcgctggatttgtgtgcccatgcactgtcaaactacgaatttatccactttctcctttcgtccaaagccgcctccactcgaaatggtaactgtcttcacaccgaacaaagaccggacgtcatccccgcttcccaggtcgatcgtacatagtatggagtccagtgtgcatcagtggctggctatttgggagctggttgtgcgaccagcctacggaatttgatcccgtctctgtatagagtgctccataatgacggtctgtcttctgcactatccactatgcacgctaccggcgcatcagcccagctccagtcctacacatacgatggtaggtctctgcaaactggaagtcttttccaggaacgtcatgaacccacaaggcgttggtttgtctagtacctgttccatcttcccctctctggacgcgaacagatttcattttgattattttatacttcctaaaaagaccagcggcctgaactatctgcataatagtcaaccgtataataatatatattccaagaaacatctgaattgtcgagactcaatcgggatctggaacgcctgcaagccttcgatcgactcagccctgagggggaagagcgaagccagccacggtgggaacatacccacaagcaccaccgcacaccgcgacaatcccatgcaatgcacaatgcacctatctttgccttagagtaccaatgtggcgggactgaaggatcgcttctcccgtagccaaacactaaaacccgcctcgcacaacaggaagtgtagaattagagccatggtgatcgaaatgaggggaatacggggaataccagacctagattcgaaactttgatacttagaactcaaaatctcttcaggatgtcccacttgattagctctacggatggaacggaagggtaattccttgcattaaacgattcggaaatgagcgaatcccggtggaatagaagtggcaccttcatgcccgtaatcgagtttcctgttggagagctacataatccacgacagacgcagaaagcccacagtcagcacagtagttggtaataatggcatgcaccttaattatggggcgaatggagatgctgggatgtatttgtcactgtctgccccgcagcgcataatttttccccagccactgactcgcgtggaaaccgggcgctcccggggggttgaagagagccacaaaaagccctatggtcggggatcagtggaaattgaacggtcttgttcgttggtcagtcgggctccagttttcttttcaccacattggatccccgaaagataaataaaggcgatgatccttcaaagtctatacggtgacatccgttccagcctcaccactcgatcgggaccagacacagatatccaggggcgatcttgcgggtgctgcttcgggaaatttgtccgtctttgcaggtgacggggatgcaaatggtccactgggtcaatggttacgatgattgtattggtccgcggatcggggataagcggacactagagactagactggcgggttagtgggttgctgggaacgcgatatatcttgtcggatgggaaaagtgggagtggaacgaaaaaaggagtaaggctgtgctgtaaacgtgatcgcgagtaatgggttccgctatggtggattcgttaggaagctttggggattaagagtggcccggggaagagtttacagttccttagcagagtttgcactatcaacgtaaaggaactaggtagtgccagtgcacggaagaatagggcaatgattggctgtgggtgaaagttgaacacaaagtatgatgcaaggacctctatgggaaaattccgatggattggacagataagccacttccccattcgcgccatccaggtatcagggattctgtgatctcccaaggtcgtcgagaggtgaggacccccccacttcccgctgttggatatggtaactttttcgtgaaccaaggaactggataagtttatagagtttcaatccaaagctacggttcaaactatcaaagcatcctgatccttcatagatatttttctcttgggttttctccccttacatgtatcgtatactatatgcaggtgatttccacgttccgccactgaggcgacctaagtaattttccgctgcaagggtgcctcctgcctcctgactatcacagggctacggagaatggagtaagcgaaagcgagtccgggcgaaggatggaccgtaaaatggaccgaggacaatgcattgaagaaaattcagccaatccgatccgactgactaggtacaaagtacaaattgtgcgtaggagctttggactttgcaccgtcaccaaccgagattgctcctaccacatatagactagattgactaggtcgagacgacagtctcaggggttaacgtagagaatctcggtagttgtaggtataccaaagtacatggttgcaattgtattctatctgcaacacattgggcgaccaacaatagattaaatgcagtagtgctgccccgacctgtagggacactatgggcggcccttcgggccgtgccacaatggagaaataatttcctactgtttcatattgctttttgcttggttctaatgtattcatctattgcaagcagcaggaacagaaagtttgcatatccatttggaatgcattaagcattattgaaagccaccacaggatgcatatttgaaatgctttcttcgcttacaataggataggcgatgatattccaaggctggaatgaacgctcattgcgattggctgtccgaagaaaagtgatgctatgatcaacagtactatcactagggcacatgagaatcggacttttgtttacgccagatgtaagccgatgtcttggaatgtcaaataccttcgcatctggtaaggcattgcttcctgaaacctctagcttgaagctacttaacgtggcaattaaattcaaatctcaaatctgcatcaattccaacctgtcgggtagagtcaaaaggccctatgatcctcaactttgacctttcccttgggatagtggagaacacgctagactctatatggagtttgacaggtttagttttaccggcccgccatccccgacccgccaggaagtggggtcgagtcgggtcgggtctgggccccagggtccaagcgagattggacttgggaggggatgatccacttctaaaagagtcatcgtcgattactggccaacgtcaaaagtactagcgtaaatgtcactgtccttctgaccatgaacttctcctgccaatcttacacctaaaagataccgaatttgagcctggaaagtactctctacgggtcccggcttcggcctcaaaacaccccgagaaatagtcgacgctggttgacgcaatgctagcctctttcggttcgatcctgctcgatcgatgtgcatcattgaacgatcgtgcgtgcggtggctcggatttgcccaacaatctgcactagtcatgtgcacttttttttggtcccgaagatccaaatagagtgccggtttgataggctgtggcgtttctataatacgaggagaatacgatcctctagcgaatgcagctacatatctcttgcctaactaggaaacatcctcagctctccatctgtcatgcgagcgggttgcctctctcaacggtatttttgtagcacaccgatcatgcagtctcgaaaccaccatctctatccacgatgatactctgcgaactgactcacactctgtatacactaccacccccctttccatatatttacccctccttcaaaccgcttagttctatttcgattgacataagctccagatggactgttggatcatccagttctggaacggactatagacatcaagtagttctaagacgaaaaacatccttccagaggttcttttgtatattcctgattacttccgtagcggtgaaccaacctaaagagccatcccagtccttgtaattagcccaggaccttttctccaacgttccagaaatgtgcgacgggcacagacatgaagttgtttggaagtgtaaaccacattcccatccccgaccccgatcgtctgattgttgcagttatctcaaaactctggcccccacccagtttattttcttcccgtcagtgcacacccgctgtcacatatccgccgagtccgccacgcctcattttgaggtttcagggtgattgcatcaccgaacaagtccgctttagctcacctttttaatggtagggtaagcggtagtggcggtcactatattaatagttggcgctgataaaatgtttgctctgaaactagtgtgataaggattggcaacgccaagctttcaaacttcctgacgtttgtcttgggctttcgaaattttctgaattaaagaccagcagggaacatccatgaacgagtctttgccgtgccttaagtaactgctgaattttgcctcttcagctgtcatgtccctgtggcagtgcttgaaatcgcctgagccacgcgactgagccacgttgtggctggtcctagcgtttggggagggatcgccttttgtaccaatgagaagctttcgttggcgattgtcaaatgttaccctgatgatctctgatacgtttaataaaaggggggttctagaatctagaccaagccattcaaattgaattggaaatatggagtaacggagtattcaatatggtactccgcagtccgtactccgtatattcggagtaatccgtgattccaaatgcaactaggacttttgtttatttatttagttatttattttttaaactatctgactctcacctgactctctcatagagtggttcacggagtagagcagtcctgatccccacgctaaaacaaaccacagcggctaaatgggcaaagcaaacaagccgacccagtaggaagatgtaacgggggcacaaacaaagagagactatccggggatgtcagtgctgaagccgtagttgttttagttacttagtattggggtatgcctagttttgcgattttgcctcaaagaatgacaaataacgtacggagtacctaccgttgccctaaaactgtttagttcgacgacactgcttctttgttgtacgtgtgccttgcggtaacctaaaaaatatgatttgcctacattgcctcggaggctactacatccaatttgcaacaggctctgcagttactattgctgtatggaatagactgctcggcaattggaatgttacattgttatgtactccgtatgtcggtaggcagtagtctacttcgatgagactaatcagatagatacaatactcaaagtacacaattagattggggttgtttgtgcattaaaaaaaacaaggaaaaatctgcctcttgcatcttccccgatatagcgtggatggatagtgggaccgaagaagtatttccgcatgtattccccttttgtcatgtcaagatagtatagagatagtaggtgggtagtgttttagatcctcctcccccctttttgggtagcattgaccgaattgggccgttacgaagcatctcctttgttccggagttaaagaccgatagtgtaaattgtatggcgtttatatccccccaaaaaacgccagtgtaatccaccgggacgggagatggacgcgttgacagagtcctgggtacggagtttcctttcccctggactctcagcacagacgcaggcggggggaagggaagacggctgattgggctgtcacaaaaagggcccaacgtcaaaaagtaccgccactaacccgccgtgggatagttcctcgaaccattttgctaccaattttcttccccgaagcgagagtagagagtagatcatgccgtcgtgttgggatgccaaacactctattatctcgatctgtcttagagcggtttttgaatttgttatagcccatctttcgcgggtaaaccggcgtaggcgagacctacggtcgtattagcacgtactttttgattcccctttcgcttctactgaaatgatttgatttggattgatttggcgagattgagatgtgagggtctgatctcagggggcttttttttgggctatgctatactcagctgaagccaaggtctattccagaaacccgaagtttttggccaccccggagttaggtatctgtcaatgaaccgagatcgacaacagcaacaagctccagacggggataaaaaagaaacagtgacagtttatcggcgagtcacctcccaggatccgggatgttgggccatgcacaagcgggattttgataggttcacgtagaatggggaaatgtggattcatttgctagtgtcggggcactttgctgagatccgaagatcgaaagaaaaaaatgttacagataatatttaattttcacatttaagtagtaagtaacttggaatataatatgataatgttatagtgtcataatgtaaaaaaaaaagaattaggataatataggcatcattatacacttttgctatgtacttttcttagattcacagcatcgatggcgaattatatttttcaaccggaaccaccgaaaggtcgatctgcacattaagaatagcacacggcttcaaataggcctgtgcgccttcccagtattttgggggtgcctggcagctagacgcgagtgcttatacgagtgcttatagggttaataggttcgtgtttatgattgacatttatattgttaggtcttggtggttgcctcgtatgccaatagtaagtgattccaagacttagggatctgatccccctaagggtgcctttgtacctttgtatctttgacctgacagcaagccatgagcctggttgtggggggtcgatcgataatgagcgccactgttggggtttgccccgacttgaaattaatggaattaatatggaatttaataaataaaatacgtagaataaaaataaaaatttaatataattaaaataattaaaaaataaaacaaaataaaataaaaaataaaaaatatgcgatctacaaatagtgggacagggatgctggatcgggacccccaaagctactgcatctactgcactttgaatgcgccaatctcgctgcacgcatacgatcacagagggattccggcttctaggatcatccatgctctgttgctggccacttttttatcgtgcttttgtcattgtacgcattaaagtctagaactgaaaaaggcttgcatatccccttcttgttcctcttgattttctatactccctcagctctatttaaaagatcatcccacttgatcatcttctttcaagatatttcattctcaaccgtcccaacccccggtgccatctttcgtttacttgggaacacaaagtggaggcttcctttcgttcctgcatcccggttacgaacagttactgtgctgcagttatccgcttcacatccccattgagccacctgcacattgtgaactccaactgtgtgagtacatcccgcctattctggctctgtttgcaagagcttgattggatcccggtttgtcggaatgccagcgtttgtcctaccggttcccgcaccggagcgggaatggccattccgccgttgggtgttcatgagaataccctcttccggggacggactggtgctgccgaagatgcttggtggcagttggctgactgcaagtccacagcattagtaccaacttcttccgaatcgcaatcccgccactcgagcaacactatctataaagagaacagtctctcctagacgtgcaatatccagatcccacatcactctcattcctggttatcttgatacactgcttcaactgagcctgaattacccttatcgaggcgatttcattccaagttcctatacgcatctatatccgccaccatggtttacagtaaaccaacaagcggagccatgaagaggtctgcctcggctctcgaaggacccccaggatggggcgatgttcctgtatgtttccaagagaaatctgggttccttcttactgacatctggtttagccaatgatgaccaactcccgctcatcattccgtcctccttatgctcactttgctatgatttaccttgaccgtgatggcaagcttaaggttgatgaatcatcttctattcaagaacaaaactccactgtgttcactccagaggttcgccagaacttcctcgagattctgggtgaacgcattggctatcatgctcctgttcgccgtatgtcaaagttctaaacaccaaggtcaacacatactaatcccaatatagagacaatggacgcatctcctcgtcgggtaagacgtcgcaagggcaacgctcctgctatctctatcgacgaccgcctgaacgagcaggataccgatagcgaggagctccctagcgggtctaccgacatggttcctctccgcattggagactctcaaaaggtcatggcatactatgagggtgcactgaagcacttccaacagctgaactgccgtatggttgctaaagcattcattaaattcatcgagcctcgcaagcaggtccgacacccttacaatggtggcaagccaccggcaggatccgcccccggtactaccggggacccagaaaagactaagcccgagtggtggcctcccggtgttatgcataaggagcctgaccacctgagaaaagagtgtatgatctagctcctatggtctaatttattctcgatctgattgcttacttattctactagaccgcattgagctcttgcttcacattatccgcaagctcggttcttacggtatcactgccgacaagctcaaggatgttgctggcgacaccaagcggagcttgaagcacccatcccacgtcgagatcatctacgagatcctacgagttcgcaagatggaggagcgttttgaacgaggtgaagtcgacggcaacatggtcgtttacactatgaaccgcggccctagccctaagggcgatgaagaagacgactccaccacctcctcagtgaccatcgaagagcccgaacacatcaaccaaggattaatgacccccatctcatcattcgagcaagcatccacctccttgaccacacctatcgacaacgtgccatcagcccgctccctcccaggcagcttctccatgagtgagcctatcaacttcgaaaaccgccaggaccgccattactacaccacacctccccagtacagcgattcattctcgcagcccatgctcagcactcccgtaacagcagagatgatcagtccccacgacgtctcagtctcagccttcgactactccgctcacaacaccttccaaaactccacacccgatcactcacgcgcgggagtaagtggtcagtacgatacctggaccccatctttccgccagaacatcttcagccctgtcgattacaccacacctgcctctagccagggtatgccccagccttcaatgccctaccagatgcccatggtaccacacatgcaagacatgtcccatgctcagcagtcccacatggactccatccaccaaagatccctgcctttccgcacgggatcattgagccacccacatcctaacgggatgactctttcccacgccgtctgaatgactaatagggtgtggtgctcttgtcacggatgattctgactcgtgaaatgggtattaacgaacatatatgagtgatgactctagtccacaaacttagcgcttatcataaggctttgccaggggagttgttgtctttttgggtatattggtataaaacttggggtcatcttgaaaggtgacggaacaaatggggtctttttcttctttttctgaaaatacttgggtcttgtttggtttgaagtgatgtttattccggtctttgtttttattctgtggtatctttctttgattttctttatggtctcaccgtttttcatcttcttattttacttggtgttggccttgtgcttttcttcttgtcttctgttgacctgcttacctgcttgatcttttggttttcgttgtgaatatgggttttctccaacttggatgtttggagctgttgataaacgagatttgggtagatacttcaaaattttattctcaataatatacaaccggttctccttcgatggtttcctttttagctcatgatacttgctatgggatgggctattatctagctatgtagtaactacccaatcctcagtcaagagacttacacgcagggtatctgtcacagacttgaatggcgtgcgtagtcggtagctcgtttgtcgaccataggaaccaatggatattaaaccaattcgacaataaaaatcgtccgtttaagtggcctctgtccttgccatgatatcttataatactacgttctctttttgtacctacttattccaagccggacctttggactactttttcggtcttatatatgcctttgtcgctctgtctctattctgaactttgattcctgaacacttctacctacctaggtatcgcaatatggttagtgatattgtatttattacattatactaaatcctgagattcaaggtctcctgccgctccatgtgtttgcaacatctgccctaaatttcaacgtatgtatagatcgcgagaggcaccgatggatgaattgctatttgcctaatacaatataaaactgtcacctataactattgccagtaatacctattgtgcctaacaagattctatctaattggtattggaatgggcacagccgcggccaattagacgcaagcgcgcgccgacataagcgcttggtcagcggagtaagcggagcacctgggcactccgctcagcttgaagctccgtgaacgaggcggcgcttcaatttccatcctcttcaatcgctttacgctcactccgtgcttgctttccggtcaccatttgcatgtcggcgtcttcgtgcggctcacgaaccggatccgccttccagtttatgccagtattgcaaactcccgacgcgcacgccggcacgccgcctcacgagcttgaacaatcccaacgaatcgcaaataccgaaggcgacaagccagtgggatcgcttatacattactttgaagaaaagagacccgtgagtgtactggtagcgtgaatacctatccccgagtccattccggtcctcagctttgtcctccggcctttctttgtatccatccgcgcctcttcggtgtagcattgggtcgggatagccatccctcggctttgtaacatgggctgacttctttgtggtcgccgcggcgcactaactctagcagataggaaacaacttttcagatctctgcgcaatcgactctgccgtctcgcatatcggaatcgtccaccccataaattccaatataaatttcaccacagagtgagcgacaggcctattacaagaggcggcagcctatccagtttattccgctctttgcgggcaggatggctagcccgtttaacccttctgcgggccgtggccacaggggaggcgcgccgggcgtgcaaggctcaacgggacggggaagaggtggccatacatcgacatatgtgccgagagggtcaggtgcgcctcgcgcagcgagggctcgagggcgtgggcgggggtcagcgacatggacagctcgtggccgtggtcgcggcgcaggcgctgcaggccacaccgtgaatgaaccccaacaacccgcggagggccccaagcctggtgttgtcaaatcaccgtttacgcaatcgaaccagcaaaaagccgccgccgcgtcgccgtttggggctcagcccgcccagcagtctccattttccagagtctcaaacagtgcttccgcctcgaacgtcgccaaaaacccattcgcccaacctacgaacattgcgaaacaacaaccttcgacgaaatttgttggcgcgggatctaatgttgcggccgccatggagcatgcatcgacgttaaacaattaccaggaacgctttgacaaagtcagtctgctcttctcaaaaacgggcaatacaactacggagctaaccaactttgcagctgaaaattgatcaagtgaggcagcgcgaaagggcgatcaaggatgggcaaatggcggaccctaatcagccaacttccttgaaccatgctatcacacccgtgggtacctgcaccagcatgtgtcctgatttcgagagggtggagcgaatcgtgcagaaagcagtcgacaaatgtgaaaaggtaatggtgcgccaatttctattttggtgccgttgctgacacgcatatagtattacaacccgtcaacggaccagctggaaatcatggaaaccaaaatggtgaaacgcttccggcgtgcggcagctggaaatgacgagcaattgccctcggatatccggacaccaaagacacttttacaaaccatgaactacctgatccgttatgttatcaacggtggtgaaccgttagccgtcatccacatgtttgtctggaatcggacacggtcaatccgaaatgacttctcggtgcagcaacttacacaagaagaagacgtgaagacagccgtcacttgcctagaaaggattgcgcggttccatatcgtgtccctgcatcttctttctaaccccgcgaacacggagcagtttgaccgtcaccaggagcgtgagcagctcaacaacaccatgctctctctcatgtactactacgatgacaaccgcgagcgcatccacttccctaacgaggacgagttccgtgcctaccacatcttgttctcgatccatgaccaacggcctgacctggaagctcgtgttcagaaatggccaactaccctacttgcttcgcctcgagtgcaggtggcattggaactatttgctgctgcctgtaatacatgggagcctcaaggtgctctggattttcgtcgaccgaatgcaattgctcagggattctacgctcgcttcttcaacatcatcaattccccgagtgtgtcatatctgatggcctgtgtggctgaggtctacttcaaccacattcgtcagacagctatccgtgcaatctggaaagcctactgccggactccgctgtcacagcaatccaaaaacgatcactggactgtggaggaattaactaaggtgttgcactttgatgacgacgagcaaacagtcgaatactgtactgctcaagggttacagtttgctgagaacgcaagtggtggactctacctcaattggggtgatcgaccagtagactctgtcggtaagtgattttaagcaacttcatctcagccgagtctcgtttggtttcatttcccacttcacccatctccctcggcccaagtttatgataccttccatcccatttcttcctctttctttgtttcgtgactaagaatttcccagactttgcgccttcatctgaccactctttctctgaaacatatgtggagtcaaagcgcgcaggacgtagtcttgtcgccatcattctcggcatgaacatcagagaagccgcaagaatgggcatgattgatcgctcccagttgtcccaaaagtgtgaaactctgcctagggcagaggcagaagatggggatctcttcgtgagtgatattgataatcagacgcccgcaccagtggttgaaacaccgaacgcccttcttcaggacacatctgcttctgaattccgggtcgcttctgagtctcagaaacctttacaacctacccctgcagctacgccttcactgttccagtcaaatctaccaccaaccgcttcaaagccgccaaatcctttcgcgccggcctttcagccatctaaaatggcatctcctccctcaaatccattcggaacttcgatcccctccaccactgttacgcccgcagctccgtctcctttcacttcttcgccaaatccgttctcgttcccaaaagagcccgaaaagaccgacacctttgccgtgaccactaatgtggctccctcggccttccagacaaaaccccctccttcacagcctgacactaccgacaaggcagctgttccgccatttactcctgccggcccttcaccatccgcttctgcctctacttcttcgtctgtttttccaaagccagcagacgccgaactcgaggcacctacaacaacttcccctgctcccacgtttcctaagcccaatttattccctcctgcaccgtcaactgcaaacaagcccgcttccgtgttcccaaatggcggccccggttctgtatcgactggcccgagccctttcactgcgccgtctccattttccttccccaagccatcggagtcaacccaaaagacggaggctcctgcggtaaccacacctgcgcagtctacgctcttcaatcccagcacttcacctcctgaggcgccggctgcggagaaacccgcgtctgtattctcttccggcgcaggcgcgttcactgcgccgtctccattctccttctccaagccatcagagcctaaccagaagacggagacaccggcaacagttgccgccgcgccctctacgctgttcaagccgtcatctcctgcatcgttggctgaatccaagaatcccttcgcatcttcggcgttctctggtgctacctttggccagacgtccatgtttccaaaggcaagccctgaggtgggcaaacctgctgcagatgtttctacacagtctacgatgttcaagaacgacaccaaaacacaacaatcatcgattgcgtcgaacaatccttttgcactcccgagtgctccgttatctttcccatctgctgctacctctgctgctccatctccattccaaggccccaaggccccagagacagctgtcaaagccaaggaacctgcagctgcattgagttccgggcagccttcctcgcaattctcaatgaacaatgcaggatcgtcggctgcaactcaatttccagttcctggctcagtctttgcggctcccaagccaccgcagccaagccagaaagcggacattccagcaactacagcgcccacgcccgagaagcccctattcacccgatctccgtcattgggtagtttacagtcacccaagctgagtgaaacttcagtactcagtcagtcggcacctgcacaggctcaaatacctggcccgcctcccatcaacggctccgcttcggtttcgggcacgcgtaggtctgtttcgcacactcaagcgaccgccccctcacctccccggactctctttgaagcacttcgacagcctaaaatatttgatgccacatcgagtacatactcgcctgaagcggcaactgctcagccgtcagcgcccttgttccaaggcccagaaccctcggtggcgcctggacatcaagcgtcattgaaacgacaacatgaggccaccgatgcagaagcacgccttcagcacaagaggcgctcctcgctgaaaggaaaatctcccgctgcagcgcccgatggatcattcaaacggtccgttcatttcgaagaggaagagcctctgtcacgggagtcgcaagtgtcttcggcgcgcaagaagtctaaagtcctcaaaaagaagcgagtctcggatgagcaaactgagcctcagctggaggaagagggcccaagtactaaggcgcccaaggtttccacagcggaagaacatgtccctttcaacttctccgtctacaaagcagaaaaccggcccataccgaagctcccgatcttggaaaagttggaagaaaagcttgcacgagccaaggccttgtgcgagccgaagcccctgaccgaggaacaactccagtacattgaagaagctcgactgaaacgggctcgccaagtcgatgaggacgagattgccctctcacgagcacggatcttggccgagaagttgaggacgggccctggaatcttcgacggttggaccggaagaatccgagagccatggcacgacccaaactggaatcccattgcccggatcgtggaaaagtatcaagcccgaaatattccccaaccaaattcctatgtacccccgcgtctgacactcaatcgcactgccagaggatacgaggtcgcttacgctcctgatacaccggaccgacctatgtcccgaaccgaacagcgtattcgacgcactggtgcccgtggacttgcgcatgtgcctctggatttcgaacgtcataagcgagagaaagaggagatggctaagagcaagagcggaaagaaggaagataacgacaaagacaagaaggatgaggaagggaaagacgtgtcttcccagggtgtttaaggagacgcactacgctttgcttattccccatgttgtgattatctcatggtgtatctcactgatttgttctcctctcatatgggccatggatctgcatacccgcttactgtgctcatctcacgttttgcatttcgtggagttctgttttcccccgatggacattcgcagcggaaatttattcatatctttcatttactttctttttctagttataaacagcctgagttataaaagaggcgtctagttacgggatatagtggcatatcacatctccactggggagacaatgataatatgtatagatctacgatgtacgtaggtattacacctctgccctcattctacggacgtggtttcctgcctcctaaggcagataccacctaatcaaaccgaggtcactccagggctactacttgtagttactatatcccaagtctacaatcatgccgggtcttagtgagctcctcaatcgacaaccacccacacacaccgtgggaacaattcctggcccagccttgcatctttcttgcgcggaagctgtacacttggcgtcaacccatccctgcaaaaccactcacaaatcctgttactatcgtctgcatctccgatactcacaacagtcaacctagcctatattcttagatttacgatctcttctaagcgatatagttaagtgctattttctatgggcgcagacacccatcatagcattatgatagataccacttgtcgtcatctttccatcattgtttgttctatagatcagtctaatattgcaagcaatacctataccatcgaaatggcataggtattctgctagatagttgtcaagcaggtgcccatcaatttcttgtaggctccaagctcccagctaaacttcccctaaacccttatatcagattgcaacgcaggatagtaggaacatgatgagaagaatcaggaaagaggcggagagcgaagcggtaaatctgtatggtcgaccaataatagcacccattgttcagctacatcgatgcacgtcaatgtccatcctgtatgagagcatcactagggaaatcaccactagtctgcaaagctctcgggatcacatatcagtagcggccaatcacttgtttgaccttgtgccttgggttgcatccaagtccactgtcgcttctgagggcgcttaatggctatctctttgggcaatcacgctagcataccatggcgggctccttcagaatgatcgcgaaccctgtcaacctttcgaccttagctcgaccttcaattccaattttccaattcccttggcgtcgaaatttcgacttaaggtcttccgtgcggccaaacactacaaaggccgggaatcatcacgtcaagtataactggatcaagggcgtggagacacttgagttatatcagcctgggggatatcatcccgttatggttggtgatgtcttacacgaccgttatcatattgcagacaagcttggcttcggggcctattcgacggtttggcttgcccgagatactcgtctaaacagatacgttactcttaaggtcagcatagccgacatggttcagcgcgagacaaaaatcctcaaggctctgtctactccgactccgtcgtcctcggtacatcctgggcgtggtttggtgcctgttttcctagatgaattcgaactgcaaggccctaatggaaaacatatgtgctacgcggtggcccctgcacaatgcaaccttagggaggcttcttttagccgtcttttccctctcgaagtcgctcgagcactatcgtatcgactctcacaggctgttgcttacacacattcacacggctatgttcatggaggtgggttatagtcactaaagatttgaatattagctaaaatcttgggtgactcagatattcatttaaataacattttatccaagctgccgtcaagtttcgatgagctttctataaagcaattctacgacagattcggaccacccgagacagtccctatcacacggcgtgacggaggaccattgccccctaatgttccatctaaagctgttgtgccgctatttatctggaaatctgcggagatgttctcattatccgacgcacacccgcttctaactgactttggtgaagctttccctcccgcttcagaaagtcttggacaggattgccacacgccaatcccgttccgagctccggaggctaagttcgaatttcaaagcccgctctcgtatccctcagatatctggagtttagccacggcgatctgggagattgtggggatgggggctatatttagtactgattttgtggatgaggatcatatagtggctcggcatattgacgtattaggacctatgccatcggaatggtggcaccgctggcacgcacggtctcgattttttgacgagcatggacagccaacggagtcatataggggaaataggtggcctccgcttgaggaatcatttgagattggtgtgcagaaatggagacggaagatgggaggcaagattgaggaagacgagaaagatgcgtttctggatttgatgcgccgtatgttgtcttaccggccggaaaaccgagcaactgctgaagaggtgttaatgtcagattggatggtcaaatgggcgttacctgattgcgagcggagttgaaggcatttccttgcgtttgatactcaaaatccatgtgctaataaccaaattacaaggatcgatgcacaattctccgaataaaccggtgttgagtgcggtagttgataataggaagtttggaggtgtagtcaacgtaggtttggatgctaagaagcacatgggtaggtcacggcgaaaggaataaaaactatacgggaggagccaatactcagtggcatatatcaaacaacataaatgcatcattggagaaagactctcgagatctgtcaagcactatgggaaacaccattgcaatgcttgggcgggtctagcaactgatattcacccctgaggcatcaactttcatatgacccgccccagaatatcgcccttccgtccaaacaccaatactctacaagtatatcgcgcctgactcggactcaaaaatcgcgtataaataattatattgagtatatcgggatatagttcgaggatttcaactcgccatcattctggcaaaaatcctgccccgctgtgtccgcgtcgggaccagaagacacggacttcatacctcgacgtcaagaacgccaacttcgaacccatttctatcacgattcacacagaaacttgccattacacaacgcgtgtcattccttaactttcgaaatttctcaacctcactgtctcacaaaatgaggattgcaagccttcaattcgcgccaaagctgggcgatctcaaaggcaatatcgagaaagcaaatgctttactgaagactggcaagaccatttctgtagatgggaaggagctcggagtcggggttgatctgttgaagcctgatatcttggtgctgcccgagttggccttgacaggtacgtacctactcaacttgtccacgagcgtgtattgagcagcagaacctcgtcttccccctagtttatgacgtttagctcaatttgtggggaattttcgctaatgaataactaggctataacttcccttccttggaagcgatcaagccatatctcgagccagccagcgacggcccctctggctcgtgggcgcgtgaaactgccagacgcttgcgatgcaaggtctgcgtggggtatccggagattgagaaggattctcaaaatccagacaacgccacgtactataactcactccttgttgtcgatgaggatggggagttcatcctcaactaccgcaagagcttcttgtattacaccgacgaaacgtgggcggctgaaggccaagctgagcgaggctttcatgagctcgaattcacttgccaaggcacagtttcttccttgagaagcccggtgcaccagggtgagcaggctttatccgagaaaaagcgggtcgcgacttcgcttggtatctgcatggatatcaatccatacaagtttgaagcgccattcaccgagtgggaatttgcgacccgagtccttgactctaaatcccagcttgtcattctgtccatggcctggttgaccatcctgagccgagaagagctcgacgccttgaaggataagcccgagatggatactttcaactattggcttcagcggttctggcccctgttgcaaaagaagatggaacatgaggtggatctggacggcggcaaggcggcagattctccgaagaagatcgtcatcgtcttttctaatcggtcgggcgaggagccacctacagaggataccaagccaccggcacggtatgcgggaacaagcgctatcatcgctgtgacgcaacggcccacacccaatcctgcggagaaatatgcaaggtcaggtgcgtacaccaccgatgcggaaagtgagacaggggatgcggtcatcccattcgacgtcaagatactttgctgggacatgctaggcgccacggaggaaggtatttgttttgcggatactacggcagatccacaaatggtatttgcacttaaaaaggcgtctgagtgaggcagcgcactggacgcgtcagactattccacagataatgcggagtctatgaccagatcgagggtccacccttgcgacatgacattagaaatggcaattcggtcacccgagtctctgtgatacctcctaatcccaggatatatgcaccagacggtgtatattgctctatgttatggtgatcttccctgcaagaatggaaactccaccgtttgccacaggcgcatcatgtgcaggtaatccatgtgataggggacttgaacgtgatgacatatagaagaagatcatcgagatcgtcgcaatcttcaggaaaagctcagatacttagcttaattttgcatcggggtggaattctgaggtctcatgatcactcagacttcacattcatcaatatgcaggcgatgtactggggaagacccttttagatatccgatgcaaccctttggagacatggtggtgtgaaggacttggggaatcctatttcaggatgcttagtctgaaacatgtgattctcctctcccccaccccgatgagggatcagaggtaaacagatgagaactagaaacgaagtaccctgtaagctagctatattgtaaagagaactgttatatcgcaatctagatcagcacacccactacataatgcacgactttgtttcccgttgctacctttgttctgggatattcccctgttgtgtttcctgattcagtcgaagggggtatcctatacactagtggccctagcctgagcgcatgcagagagacactcggacggtcacttcggatcaaatgccgggtatatcgcatgtagctagtaggcttctagtgtgtctagactacgtccatatacttgataaatgtgtagataactagaatttcttggtatccgacggtccgatcccccctcgtagtgggtgaagagagcctgtgattggcccataagatatccttacacgtgatctagggatttccccctccgagagctgtcagccaatcagaggccaagaaagaaggtgtgcagcagaggggcacggggtagctgcacatgacttgcgatgagagatggaggcgtagaatccccggagctattcaagcattttagttggttatcttcagctcctgctgtccgtttctttatggtcgtgtctgcaaaattgtctagacctccagggctcctcggtggctcatttacggtatgcggtttgcttacgtcagtggacttttttgaataaggcaatcaggtgactttgcactgttggtcgttctgatccgccgtattcagcgcgactcctcctcttgaccacctccttgccacgtgagcaatccatcttgaacttgtccgctgctctacatcttcctaaagaaacgcgttttcttgtatctaaatttaccgcgaggtagattgctaagtcctttgcatatcttagtatcggcttcctcaaattttcaactttccctttttcgcgtcccaatttcgaactcggggtttcgcagacaacgtgacctgcgtcttgttgttgtcgggcaggtgacttcctgtcaggtgataaagagagatcatcccaaggtacggctccatcaatacccccatccccatccagaaccccccatgtcattgcaaatcgtgtcgcgatgcccatcgcaagtggtgtccttcacgacgctgcccccctgtgtgacctcaactgcctgcaagccatcatgacgcgttcttgatatctgcagccccgcggatgtctcgaggcatcgcattatatgcgatcgcttgacaacgtcccttccctgtagaactatccatgcactgccgcccgccaggaaaacctactggcgatggctgagcccgacgttggccggcctccgtgggatgcattacaagcgcgtcagatccacgcgtctgtttacttcgcgggggtgccactgatcttcccgagagggacttgatctgccaggcgccaacttatcgcaggctgcattgacttctccaatcacataccgttgtcttgttctcctattctccgggacttgttttcactttactcttcacttattggccactaaccaccaccacgaataggaagatcagctttaaagctcagcatgtctgaccccaccatgaacagcccagataacggctcgcataagcgcaagagagatggctctgaggatctaggtcccgacccgcagcgccttaaccgctcctcccacggaagcaacggcagcatggataaccagcacaactttggccactctgcgctcggaaactacgaccacgggcttcccaacactggcgctgagctcaacattgatcaacaaattcttcaacatgttggtccgcagaacggtctgtccgacgataatgcgttgaccgcaaatgccaaggccgccctggctgcacacactcctcaacacaagtacccccctcctcccgactccggctttgatgccagcaacctcacccaagggctgtcctttggcgatgagatgaaccagactcccatgggtggtggtcacaaccacaattcgactgctgctgcggtctatgccgcgcgcgaggctcagagtatgaaccagaagcctaccgttggttctcccgaatggcaccagatccgcaagaacaatcacaaagaaggtaagaagcacatttccgaccgagttcgtgtttgtatactgaccccttcctctagttgaacgtcgccgccgcgaagctattaatgagggtatcaaccaaattgctcgtcttgtgccgaactgcgataagaacaagggcgcgattctgcaacgtgcgatcgaatatatcctccagctccaggaagaaaagaagaacatcgatgagcaatttgagaagcacagtctgactgctaatcatgctatcgccgagatcagcggctcgaactccaagctcaaaggcgaggtcgcccgacgcaacaacattgctctaaagtggctgacacgttgccgggatgccggcctcgactttgatgattacgaggagtcaaaagagctagagtcactggagatggattaggcttatcatccttgttcttctgcatgtgctacgacttgttgcgttccggaggtcaatacttgaacataccctcatctctgtttttcaaatctgctattctgctgttgacagatattttctcttcttaccatggacgtttcctccaattgatgtaccctcaccatgaacctctccttacgcgcgtctcttcgcaatacggtctgcccctggcattctgagtgtttctgagttgttacatttcccactaactacccttgcgacttgtgcaattttctcttctgctgttgcttaccccctttgatcattctctgctcacacacatctgcggtctttgtacgctacctgggctttgttttctgttttctgttttcttttactttctttcatcattaatggattgtgggctggcgaatcaacggctggaatgggtttgccttggaacggagctgcgggttgataagtccttatttgaaactgttttattctatccctttctctactgcttcgtaggaacagtgttgtagttgtatattcagttacccagtcgcaacaagagcaacctcgggtgactcgggccctcccgagtcacccgaggaagaacgaacacatcgagttatgtatatagtgcctcacggagttgattagttagtgcctaaacatggccctaataaagatcgacaagtatgtacctaaatgtacatccataaggcgtgataagcagatcagccactgacggagcggagataacacagccctgatcagcttataggctacccctctatgatgtcaacgtggacgtccacctttccttctacttaaattctactttctcctttcttacacatttccatcatctaaacatgtcttcctatattgtgagtaaacaacacattcagaaaatagacatcttgctgaccctcctagatcacctgcaagccaaccgcaaccgacgacgaggtccaggcgtatgcatcttacgctggtagatagtcatttgaaatacactatactaatacatggatgtcttttagtgtcaaggaccacgctcagaagcaaggcggtactattggacacgagtactcgttgatcaagggctttgcgtgagttatctcgacactcggtcttcttccagcgtgagatggctaattcttgatcttgaccttagtgttactttccctaaggatacggtccacagcctcgatgcacacccgcatgtggacaatgtcgaggccgataaggaagtgacgacgcagtaattgtccagatgtgaggttgcggatcagctgcatggcaggagcatagattcgttagcgttgtatcatggcctacccaggttatggggtatacgacttagcttttactagtcaagcacggaattacaatagatcaaacgaactatatgtttcagatatagagtgcccttgtacaatcgaccttgctatagatcagttcagttgcaatagactaaatagcgaacacagacatcctcatcacaccatcaaaccacctcgataagaatattaacagaagaaaataaatataaaccccctccgcttaacaaatctacaagttcgacccagcagtgacttcactcccagacgaaacaccaacatccttaacaacaacagtgctgccactagcaccggtaatccgcacatcaacagtactagtcccgaacccggcagtgttctcgaagtagttatagtaagtgcgggtggtgctctgccacgaactaccgccgtcagtgctaacctccaacgcagtcacagcctcattggcattgacaacctgcatcgagaaccagtaggcagatgtgccctccttgttcttgagctttagtggtccgtccaggtcgcatggcacgtacgaccaggtcgtttggatgatgccggcggagatatcggagagctcggcgaaggcctcttggaagaggtctaggtggttgctttcgcattcggggcattggtcgacgatctgggttgggttagagcctgtcgggatgggatgggatggggcggaatggtatgggatggggcggaatggtatgggatggaatcagggcttggctcaccattgctttgatggagttacccttcggtccggtgacggatacacaggcgccgcagtttgcggcatcgtcccatcgctggagggagagggccgtgccgaagaggtggcttgggagggtgtagccggagaacgagcatgttccgccgccgacattgccaccgtagaaggtggcttttccgggggttccgttggaggagccggtggatgcggatttggtggaagaggtggaagtggaagacttggtggaagtgctggcgacttccgcgggagcttcggtggtggagggctgcacgacgggggtcttcacggctggggcagcaatggtctcgatgacggcggcagtctcggctgatgcagtgggcagaggagccacgactgcatcggtcttcggagctgcggtctcggcgacttcggtctcggcagcaggagctgaagagcttgtggtctcgacttggataactgcgacgggagtcgtagactccacggcaatggcaggagaggatgaggccaatgtgggctcagcgggcggttgagactcgacaatagccggagtagactccacggaggtcgtagatgggtaggattccacggtgatggtcttgtagtagacgctcatggtgtagcccttcgggcagtatccgtcatgttcgcgggcgcccaatgggccagcggatacagtggcagcgctgaaaagagcggccacggaggctagacgaagatacttcattgttggatgaagtaaatattgaagggttcggtaagacaaagtaccgaagatggaatgaatgacagtcacagattgactttttaaaaatgataggacgtgcaggtgcacttcaaaagaatggacgtctggataacgaatgccagattcgaaagagatactgttccagacaggaagtagtgcaaagaaagcgaaagaaggtatggaaagagggagaaaaagatgggatgggggagatataagtctaagcgccgttaagagtccatgctcatactccatatggcttgatgaactagtaaattgatcatttcatccgtaagaactatgctcaaaaggtgaaacacgccgtggatcgtgggccagtgtgaatgctccggagaagccgaaaagggcgattgacccatagtgctataccgagttagggttagtggaggttgtttaaattaaagaggaaatgactgtgagtcaaggtaaaatgagattctgttcctagcctattagtgggtttctcagaaagaaaaatcaaaagaactaaacagccctggactatcgagcatcccacataatctcgttcagccttagtagcgcatccgcactggcctttttcgccgacataaagtcctctcggctctccgccccgcgtggaccacggagaatttcagagaaacataggtctacgagaacacgcagctcctcgtaggtaaatggctcgccgtttccagcagccaaggctttgtcgccttgtgacgcgaaagcctccttctcttccttggcgtagtccaaggccttctcggcgccttctaggaaccagtccaggaacttggcgctgcgtggtagagcaacgatttcttgggaagcctgcgcctgcaaatctgcagttgactctgatgaatcaccagttggatcgatgatgatgttcttcaagttctgttggagaacaagcacatcaagctggagtcgcagcgctccattctcattcatggccccgatatactgggtacaggcgacaaagactcgatcgataaaccgtgccagacccgaagtgatgaaccaacgctcaacagatcccaaatacgtcgagatgttggtgtcgaatgcgatgagatcattgttgagtgcgagaattgttggtgatgcagcggttggttgattcatgataatgtgccaccagttgtccgttgtgtttggggatggggtgacaggctcagagttccgcaaattaggaggattcggcccggacattgttttggtcaacatgtggatgattccacagcggatgtcaacatgcatcgtcataattgcagtatccccaagccggtgtagtgattcgagcgtcccatcgaagaccacggcagtctcgtggttgagtggcaaatgcaccgggtgattgatgctatcgcggttgggcttcacggacccgaacagagtccatctgcgagacggtcggccagttgcagtcaaactggatgactcggcatccgcggtatgttcaaccacaagtcggattcttgcgaggtgacttgagagccattgcatgctgttgtacaagagcgaaagggaaatgacggttttcgggtcagatatgatgtcgtaaggctgtaaaggcacttggcctgttcgcttgagaagaaggtcgatttccgtatcaatcagggtctgtttcttatccccggcatctttccacagttcatccacaacatcatggatgtcgcctgaatcagcaaaggaagccgcagctttcagttggacttcgcctccacggttccgcgcagagactttcgtgaccattgctttgtaccacccacagcacttgtcataataggtcacaatctggtcaataagaagctgcgtgaatgtttggtcatgtggaatactcgacagcattttgctaaattcccgaacaatggacatgaatttgatcgttcccctgaaaataggccgaggagagaacttggcccagtgggggtcttctgtaaacgcatctgcggcgatgaaactgagcgtgcagaggtccgtcactgtttcatccaactgcggcaggaagacattgaccatgaagtcgtccaaaaatgaggtcaaactgcccatggaaatatccgaatccacaggaacaatatccttaagccgctggatgaaggatagagagggaggaagaaggattcccatattgaagacacttggctcgagcaaaatcttatgcccagttcccgagttgcccttattagattgcgtagtatcgcttgttgcagccttttgcctggacttagaaacaagccctggtactgacgacttgaggatttcatcgagttcgtcttgttcggctttcatctcagaattttgctcgatatcggacaacttaaacattttctacaatgcaaacaatcagctagttgaaagtactgaaaacgccggtttcttaccttattcttatcgcggtttcctgtgtatagatgacgtcgagcatcattctcctccgatctagatcgaacagaagagtccccatcggttgcaagatagtcgtgcatgagagatcgtatctggcaaaacagattaatatccgcgatgcctgtcaaaaccgttggcatcttacctcgctttgtagaagtttccacaactccttgaatcctccagaaagcgtctcgcttttgattaaaccttctcgttcaacaatggccgcaatgacatcgtgaagaattcggtggccttccgcgattgcctcaaacttggcatacagtgcccacaaaaactcagaaagcacgtggccccgtttttcaataatctcagtggggagactggactgtttgtagttgtcctgggctgagaagctcttggttggcgcaggatagcgagtatcgacctctgcgttcgtcttatccaccacagcaaacagttcgaccggaagacgctgctcgatcctgtgaaccgcgacgtcgagatgacccatcttgttcaacgcttcgatcaataactgaatgtaggaaaacgtgtctgcctccggattccgggaggcgtcttcgaccataggcgtcaagggatcgaacttagccaggaaactatacacaggacgttcccaagagcgactaccggctaagttagatgtatgcacctctttttcatcagatgcgggtgctttccatcggtcagagcaatagggtgatttgaggtacaaatggtcgtgcaactcttcgatcagaatgtctgtgagcgacgtttcctggtttgtgaaataagcgcgaatatcggatagagcaccaatatcctccagttcagagcgccgtagaactcggagaccagtgtgaagcacatccacagctgcaaggaagcgcttatctgagatctgagattccaatttctcgggaagggattggatttcctcaatctgagtgaacagctgtacgatatcatcgtagttctgagaagacgttgcaagcccttttaactctggcttggtcgatattaacccggttttggcctggtccagggcatgtctcaggctgcgtacccgagcttgcgaggaagatatattggattggattttgtggtatgttccaatagaactgttaaatccctgatggtgttctgtaacatgaaactttagcatatgtctgtcctaaccactgcagagaggacctaccattgacaattgccttcaatgtcttctggatgtcattgtacatatgcaaaaactccggttcacggtccgctttgcccaatgtactcgtgtccatcaaactcaaagcaacgtgcaccgggacacactcggaatcagtcataaaatcccaatcgcgctggatagactggagaatagctgtaggaggtagccggattagctgttgggccaggctagtcaaaagagaaagacatactttcaatggcctggggttcccccgagtcattactcgagttaaccacaggcgacgcattcctctggctcctgtggtccctttgttccctttgttcccttgggtctctcttgtctctgtggtctcggtggtctctttggcctctcgggtcccgttgatccctttggtccctgttgtccgcgtaccgatttgcatctctagaccgttcttcctggtatttcctgtctggttcttgattccttgtgcgtgatcgcgaagaggggtgcgaagaggcttgcgaggaggggtgcgaggaggggttcgaagagggttgcggagagggctgctgccagccccggtccgttcgatcacgccgccgctcgggcgactggcccggcgcaggagattggcctggcgatagcgccggaggcggaggcgcgtcggggtagaaaccaccgtatccgccggggcgacgatctgaacgtccacctccgcctggtggtgcggcacgtccaccgtatccttctaccgcagggttgctgtttccaccgtatcccccgtcattggcatcgtaccgaccggaactggtgtagccatacccgttaccataaccgttttggccgctcattccaaatgatgcccgctaatcacggggtgctctggttcagtatggaagcgttggtgggctgtgacaaggggctggcggggggctgttagccagaagggttcggtattaggtcctgtaacttgcgcgcaacagttggcgagaggctgcgagcattcttaggtgtgaaatacagggagcgctggaagcaattcggtgatgccgtggtgatagtgttgaaacagaccggggcggagtgtcaggctccaccagagcttcccgcattccgttccactggccagttgtcagtgtactatgaaaatgaaagccggggcttacaacgtatacatagactttcgttacaacttcgtatttgattcactctttggtattcatttctagatacagcatcgaaatcgtgcatattctaggctgtattctacatagtgccgtctaatcaatagcagtggatatcaaaccacagcccatcaagcccgtagaccacccacccacttattttgagataggctgggtctcacgctcgagccacgagcgagtcagattgtcttcccggaagaagtgctctgtcttcgcccagatctcagcatggtagtcgtttacccacttaagctcggcatcgctcaaaagcgacggctcaatcaggttgcgaccaataggagtcattgtaacatgctcaaagcctagccactgcttgtcaccaaagttgtgagcagtcttaacttcgcgagccatgacgatgtctataaagagaacgattagcatttttccaattgaagtcataggcagtacaactcactctcaattcgaataccaaatttgccgtcctcgtagtagccgggttctgtgtcagaaattagtttcggactacaataaatagatgaagaggtacaaaccatccgagatgacatttccggcggcaatgggcacctcggtatactgaacccgagtcccgatgccaataggaccctcgtggacgttctaaacaaacattagcaaagtgtaaggtgtctcatcggcggtaatactcaccagataggaaccaacgccatggcctgttccgtgaaggaagtccaagccttccctccacaagtgctggcgcgccaacacgtcaattgcaaagccactggtgcccttggggaacactgccatgtcgattccaatagttcccttcagtaccaacgtgaaagcacgtttctcgaactctgtgggaacgccgaagtggaatgtcctcgtggtgtctgtcgtgccatcgaagtattgacaaccagagtcgcagagatagatggcactgggatcgatgatagcacagcttcccttctcgggcttatagtggatgacggcaccgttgggcccagtggacgagatcgtatcgaaggagagaccagcgaacagatcatgcttagagcggatctgttccaacttatcagctccgtcgacttcgtccaagacagtcttcttgttgataagttcgttttcaagccaagcaaagtactcggtcagagcagcaccatcgcggatatggcacgcccgcattccttcgagttcggtttcattcttaatagcctttgcatcggcgactgggctgcgggcctcttcaacctgtccctcgccaccaaggctaaggctgagagcccaagaagccttgttcgacaacaagaacttggcggcgttctcacccgcagactggcttttggtgctgagggcttgagcgtcagcaaagatggattcgtatggcttgacgacaacgtcttgtcccaagtgagctttgacctctggtgtcaacttgtcatcctcgacgtagatctcagcggtggtgggcgtaataaccgcataagagaaaaacacggggttgtagggaatacttctcaaagtcagtcaattgccaatgatgcatcacggtaaagacagtgttcttactcggttcctctcaggttgaatagccaagcaatttcatcgagcatagctgcaatagattagtcactctacaggactgggatatattcgaggtggccatacagatgacgaatccggccttcttcttcgactcaagttccttccgcagctcggccaccttttcttggaacgtcttgccggcatacttctcggggtgaacgcgcactttctcactgggacgcgcagggcgttccttcccccaaaccaagtcgaccaaattctcccggacccctacgagggatgaaccattctttttaagggtctctgccaacttccgtgcaccagctattgaaggttagcgccactatacacctccacatctgacataattatactcacatgctgtgatcagagaaggatcaacacccacagccttgcctccttgggcctcttccgtggtcctatcaacaatatcagttcccgtacaagccatgcccgcacgactgtctctcgtaccattcctgccatgtgggcacaccctcaactccacccttcaagagctgccagttgttatccaattgtttcgcagcttggttgaagtaccgtccgtcggtggacaatgcagctttgctcagtgagataattgcagtaccggcggagccagagaatcccgaaatgaactctatgggaatgttagctgtcgacgcgggccaataaggggggcgatcattgacctcgacgggcatcacacggcgcaatatactcggactggtggctatcttctgagggcacaactatgcgaaactggtaagcacaactcgaggtttaagcaaccggctgagaaacagagatgatgtcatactgtaaacatccaccttgtgctgctgcatcaactgcctcagcttcgacagccgttcagaggtatccacggcccccatatcgacggtatagcgtggaccgaaaacggagaaatatcttggacgagggaggggccttagcgatcgcaaagatgtccaaaggcgaattgggtgggagaggagcatggacactggtagactccaagaggattcttcctcaacctgttagctttcgaaaagctaagcgaagcagggaatgaacgcgtcagataagtgcgcgataagctaattccgcaggtcgtgtggactccgtcgtaagtggccttttaccaagtaggcttttggccacagaccgatctccggagtcgcggctacacacggggcccacttggtgttgtcatgtttgcactcttttcaaagggaccttctagggacattgtacacaatcatattgttcgttccgaatgagaaattgtttttccagattgatcttatctgattttagtgccaccgataatagtataaaactaatcctttgtacgacatggcgccaagcttgatacccataccccataccctagaagtaacggtctcagcactaacaggacctgcccaagtgtgacttgtcggtagaagtaagaaatgcctcaagaagcaaaagctaggattccgtactatttccaaatcaagctccatccgctaaggatgacgccaaaagctcgagggtgtgccaaaacaagatattcaggatcgtgaggacaaggcaagtatagaaggttacagacgacagcgaaagcttggggaaacaaccttgttgaaggtcaatgttaatatgtactatataggtaggctcttgcatggattttcggttgtctgtttgggcattcttccttattggcgttcttcaacatatctactcaaaagaggtcatgtcatgtgcccgggattcagagaatgagccccgcagttaccgctctaataaccgccttagcggtgattggccaactgataccaacactagattctgccagtcatacccccgtgcttgtatatgtacacttctctttttcattttcacaaccacgcgcttgctgaaacaaaatggcaacatggatgtctgacgagggccttggagctagggaatcaatgtcagaagcccatattgtatgtgtgccttgtctacacctgacattcagctaacaaagaaccagctggttaccgagctctataacccagcgaaccagcgtgaccccgccagaattaatgagatccagacgcgtctccagcaacttcagaagacagaaaatgcatgggcaattgcagattcacttctgcagagtgaacactctgcccaacatcgtttcatgggggcccttacattcacagtgaagatcaatgtctcatggtacggtcaacctctccgatccgcgccacttcaagcttatacttatgtgacgataattgctgatgccggatatcattaggagcgaaatcaacgtgaattcggccacagagatcatgcagcacttgatcaatcgttttgttgctttggtaaccaatggtgagcaagcaatggttgtgagaaagcttgcctcaagcttggttgccattttcaggcaccctgtcacaccatggaaacaggctgtctggcagctggctgcaagcctcgtccacggtggatacgtatccgaagaggaatcacgggcggtggatttccaggagcggatactgccagcgttgagcaagagtggatcgggtgcgctcctgtttttctcaattgcactcgccgaggaggctctcagactggactctgagccccaggatggggctggagacacatccgccattcagcgagccatacataacattaaggatgggttgctcctggttcaatttgtccttggggagattatacagcatgcaaagacagctggggatgatgcagttgatgtggcacttgcagctgaagccatgaattcatggaaggtgagttaatctcggtttctggtacttccgttttgaagaatggggtcgctgatttgacttccatctcgcagacatggctaggtgttcatggaaaccgccaacgttcttctgctgaagatgtcaatgtcttggcggtgcgatgtggccataccgtcattgagacgttgagggtacccagcttgagtgaaagtgcagcttctattttgacgcaagccttcgaaacccgctcctgggcgtttgacgacaactcgttgtggcttatttctgaaatcctcgccgattcaatcgtaacagctcacattactgccgtgaagagcggcgatgaaggagtggagagcatgtcgtttgttgacctgcttattgcatacgtctcgcatttgcacttggatatcttcagcgaccctatgaccccacaaaatgcagcaatcctcgcacttatccatgggattttcaagacccctggctatgcttcaattgacgacctcgggaccccacgtgtcttggagttctggaacgatatcgcagaaagtctccccggtcaaatcgaagaaggcagctctaggtatgacttggtaaagtcacatctagcagaagttgttttgggtctttccagcaaactactatatccgaagtctgaagatctggaagactggggcgaggaagagcggagtgaattcggcgccttccgccatgacgcttgtgattacctactttcggcataccccgtcctcggcgtcgacctggtcactgtcttccagaggagcgccacgtcctgccttgaaagtcgggactggcgaaatttcgagactgccatgttctgcatagctcagctctcggaagcagtggatgagaatgggcacgccgaccagtgtctcgacgccatctttgggagcgatgcttttgccaggctctgcgcaggtggggagactgaaataccactcaaggctcgccagaccctggtggattcattcggaaagtatgaatcgtactttgagcgtcacagttcgttgcttcctgatgttctaaatatcctgttcgaatccctcaatttcgagttgtgtgcgcacgcggcttcaaggtctatattgactctttcaaaatcgtgtgctcgcgtcttgacgtcggatcttcccgcattcttagatcaactagatcagttcagaagcaagccgacggcaactgtgcccaccatgcctaaggtcctggaaggaattgcgaccatcatccagtgcttgcatagtgaccaggaaaaggtacaaacgctagaaagaattctcggcttctttgttcaggaagccaacacagcgcgggaagaggttaccggtcctgctcatgaatttggtcgtcaacgcggccaccttgtgctgagctgcattgcgagcatcggaaaaggccttcgttcagaaggcgaagtcatcgatatcgagcttaccaaggaaggagacccataccccctatccttctggaactctggaccaggtgccgaagcccagcgcctgattatggaggccatgagacttttgattgtcgacttccccgtggacagcagcatcattgaagcagcctgtgacattttgaaagctggttacactgagcgggcaggtcttttcgtcttcccgccttctatgacagtggactttatcaagagctttccccttggcatctccggtacagatgttatcatggcaactgcgtcgtcatttttggcatctcacgctcggcatgcgatgaacatccgcagtgaggctgaagcgcttatcgatcatgtagcccagctcttctcttcgatgctccaaaatccggacgtgtatgacccagagaccgctaatgccgggattgatttcctcacacgtcttttgccaaagtactatccgatattgttcactcccgcgaagtcaaatctgaccgcagagtcccctcttgctgtgcttcttcacttcacacttcacgcattgacacgacctgagccacttcctcttaaatctgcttctgcattctgggttgcattaatagatctccgcggcagctcaccggaagaaatgaacatactcgaatcggtccatcaggagtttatcccccgtttgtgttacacaatcatccagcagattgcaggccgatgcgcacgatcagacttggtctctctgaacgatgctctacgacgcactgttttcaagaaaatggcattggcgcgcccagctattaaggctgcactcgactctttggacgcccaggtcacagatgcgaacggacaacaagtgccgctcctatcggcgcaagacaagtcacggttcttggagtctctcgccattgctagaggcggtcagaaaccgtctctggatattgtgcgttctttctggttgaaatgccgtgggatgaattttgattatgcccaataatggagcttgcgtggtacatgacctgatgattggagttgatgggtcctgcaacttcggtgttcatttagatatccatttgcatgacatgcgtggtccagcttgatttaatcttacttgggagtttttacttgcattcatataagcgccataactgaggaatttccaaatcatctagtggttcggccggcgtacaaaaaaggaatcatatggtccaatgcgtaccagaccaatgcctatgctactgcccagcagtacatggcctaacaaaccatccgaccgctagcttcggtcccaagaggattccaggaggcctcattaagggctcattgctctaaagtaccgcacaacttaggttattgcctggggaatatcttgtcgttttatacaaatgccgaagcacgtgcctatagacccacttagcactaactctatcccaaagcatctgagagacatacaacacagcccacagagcaacaagagacatctcaaacgacacctaaaaatacattgcagtagtacattgataaaatatcatgttaagccaaccggatattaattggaagtatccaagccttacatcgccaggtatagaagctacataaccgactattcttatagatattatataggtttgagcatgatacaccgaaattgagtagcagaacacatcgtaagaacgttgaataccgttttccgcgaatagcctccaggactctttccgtaattccccgtcagcgggccgccgtcggagactacggagactccggcgtgacatggagatgacaaccgaagccccgattggccatattctcttagtcgcggactaaaaacgccaatcgtgacttttgctatcggcatgaagctccccagactcccggtgatcggtggctcggtgccggcagcctatcacgtggcagggcggggattagtttaattcgtattatgcaggagattctgccatgaagtaatagtcccgaatagtcgaagccctgtataatgtcggatacaattactctttttggcgaagaagcatttacactcaggaaagttcactacaacataggtgcaatgattggcttcagaaggacaaatgtgtcaaatcgtataatgtatatgtcacattagacatctactcatggctcatgtacagtaaatttttaggatacaacaatgatcaaggctgaaacacacagaaaagcatatctaccaaccacggccagccaacttatcagcctcgggcatttgcttcacattgataccaaccatagcctcaccaagaccctggctgacctcagcaagcaccttagggtccttgtagtgagtgacagcctggacaatagcgcgggcacgcttcttagcatcgccagacttgaaaataccagagccaacaaagacaccatcgcagcccagctgcatcatcagcgcagcatcggcaggggtggcaacaccaccagcggcgaagttaacgacaggcagacggccgagctcagcagcctggcgaacaagctcgtaaggagcctcgatctcacgggcgaacgcgcgcagctcaggctcggcgtcctggctggcgaggaggataccgcgggcacggctgatctgcgcattgacagtgcgcatgtgcttaacggcctcaacgacatcaccggtgccagcctcacccttagtgcggatcatagcggcgccctcggagatgcggcgcagggcctcgccgaggttgcggcaaccgcagacgaaggggaccttgtagccgtgcttggtgacgtggtagacatcgtcggcgggggtgaggacctcggattcgtcgatgtagtcaacgccaatggcttcaaggatctatatatcagtgttcgttagtaaaattgttactgtttgttcgcctcccccgccaccggagatctctgctttcgcctccatctgccgatctgcccctcccccgcatagagataattgttcacatacctggcattcaacaaagtggccgatacgggccttggccatgacgggaatggtcacggcttccatgatctccttgatcatgctggggtcggacatgcgcgcgacgccaccctcaacgcggatatcggcggggacacgctcgagagccataacggcagcggcaccggcttcttcagcaatgcgggcctggtagaggagtccgttagttctctatacttggccggatagtaaccaattcctcatagagaggtcatacctgctcggcgttcacgacgtccatgataacgccacccttcagcatctgggcgagaccggccttgacagtgaagtcattgccggtggttccgttgggagcagccattatgggttgtgtaaaagaagggaatataaacagaaaagaagagaactgaaggataataaaaggagaaaggaagagagcgttccgaaagtgagtcagtaagaaatacagttttccccaaagttacttgcctcaggccaatcacgacccagagtgcccctccgcaaaagttcccctgtcaacttgcctttcccgaggagatgcccctcggtgaacaacagaccgcctgctctctggggacacaagattttctcttggtcacgttacgcgagctcttccaaccttggaaggttccaaggctcgggacacttccaaggttggcattaacatgcctatttcagtaagtgagacctttccatcatttgggcaggtggcagtcaagagtcggattgatgagggaaccccaattctcgtgacttatcaatattaaactttatcctattttggcaggagagttacttgaagcataacacggtatctatcaggatacaagcacccatgcctggatatgcatacatatgtatatttattgattatacgtcatatacgtatgatccagggtcaactatgcagatatatgtgtactacatgtactgccatgttcccatcaatctaacattctacacattccagatgcctatatatctcccagtagtcataatatacatagcttaccagtcatggatctaacgaactagattagactctaaataagaaaaacaaccctggaacccaaacttcaaaccagagcctcaatccttcaagatccatccatagatgggctcagcgatatatgacgtcacctggcttccttatcggccaaggagcgcatatccatccataaacccttccaaatccgactctccaactccctcaattacaagatagacaagcaaaacagaccacaatgtcttttagattattcaccggccaaccagccaccctcctccgcctgggtctaggcttcggcatcggcctctccgccgcaaccatgcaccccttgtcgcccttccgcgccgccccaatgcaatgccagtacgccgtgccccaacaacccaccttcaacagagattcagagtgggctgttaattccgccgaatctttggggcagaagcagggccgtccgcggcagactggcctgttgaacgcggagactatgcgccaggttagtttggggagtgtgttgggccttgttgctggtgttgggttgagggcgttttcaaaggctttggttgttattttgggtatgggggttgttcttgttgaggtatgtataagcttctgccggagacttgggctttccattggctttggtgtttcgttgtcagacgttatggtatggtatggttatactcgggacggtgcgctgatgcttgttctcaatctagtacgctgcgtctaaagggtacaatatccttccgatcaaccgaattcagaaatatgttaagcgggtcgacttgcgtcgtgctatgagtgagaaacggccgttcaagatgagtttcggttttatgatggcgatggcggcgtttgcgaatttctaggttctgccttttcggttaaacggagatttaacgctacttgtacatacgaacaatgccaagttggtttttgccaactgacaaggacgcaatttgggcggttggacgcgcatatttgaattggtaaaatgttcattcgtacaggggtatcatgagtcttgatctattccacaccaaatacagagggggaatctatgctaccccagcaccagatcctccagcacgccctccatttcatcgcgggatagtggcacacccagaatctccatgccgctggcatccatgcgcgaagtgatcatctggtggtcgtggaactccttcagcagggtacggaacatcatctccgaagaagcgacaaactcttccgttgctttctggtaaagaaggcggaactcgatgccagtttcatcgccaggcttgccgccctctgccgcgccttcgtcgtctgactggtgaccgtcgtccagtagagtgatcagttctgtcagcaggagacgatacaggttgcgtgcattctcggggagactcttgagcacaaagcccacgccatctttcccgccgacacggcggcccttgcgtccaaggagagcgttaacctcctcgacgacgtcggcctctgctgagaacggaaggaaggttgtacagtcatggaagacgagattgagttgatcacgcagactgatgtcccacatgaccgggaaattgggggtatcggctgtaaccaggagacggatgtgcggtgttgcagccagacgggcaaggagcgcttggttagctgcgcgacggagaggcggggcatcgatggagttgatcaaaacggtgacgggctcttcatgcgatttgagcgcagattgtaggagttcgaggacttccgttggctgcgcgccaagcttagatggtgcattgtcgcccatcacggctgtgacgatcgtagcgaagattgatcgaatggatatgcctggcgtgtaaccattgaccattacgatggttggattcgtagtgtctgacaagcggtggtcgtaaatccactccgcgaattcatccgttagcttgcgcttggagccgtagccaaataggcagatgttgaacccttcatcgaactcgaaagcccactgcgggaaagatcggtggtgcaaggattgcaggtactccttctcttccttgcacggatcctcatattgtccaagcttctcgaaatattcctcatgcgttagcagcggtactttgttgagggtggcatttgatgtcttaacaggaccagcgcggttctggaagaagtatcgttcgtgggcagggagctcgccttccggtgtcggggagcgcttatttctagcacctttcggtcgtcctgcacgtcgctttggttgtttcactcctttttcgggggcatcatcttcgccttcaggttctatactctccgccagaggctgacctgcattctccgtgtcaggctgatctccatgtaagatttcctccgctagtcgttccgatccatcccaagctgtatcctcgtcctgctcgaacagcacccgtgcactcttcttccgcgcagatcggtccgcattcttcactcgagatggagtcgctgcagttgcggacttgggtttggtaggcgtagcgaacaagccacgagccttagatttgtgggtgggcgttttcagcccagactgttgtaacggcgttgcagaggcaccattggcctttttgggtgttgattgaccgcgtcctgatgggggcagctcgtaggaggcatcgccgtttgaaagtgaagcgttaggcgcgtggctgttcaacgcgccattggattgttctagggctgttcgtcttctttttggggtcgagacaggcggctggtcgccggcgtctgagagcttacgcttcatggcgctttagtcagattatagtcacgtagacgcgaagggaaggaagcaacaataccatcagatccggagaatgtgcacagggtcgcgacgcaagggggttccaaggtaaattcgagatctcgttattgaagggagctgcaggtctgacactggaatgcagggcttaattgggtctggaagtgcttgaaggaattgaattggagcgggtgggtttctccgactcggcgtctccaggttggaggtagaacggcgactatcgactgcactgtcttggattcaacacaatccgcgagattacaccttgtatcctgatctgtgtcatacgcggtcggtctctctactttgtattgttataaaagttcaattcaattttactccagagggttggactaaaaaagtcgcgcatgtagttgtcatgtgagcaaattcactgatcagactaaattccaacttcttatatttaaagtactcatagtattcagcaagcagaggccaaataatcaaatcactcaacatatccccagacacctcaactgcagtgggctcataccgcgcaatcagttgccgagtgcggagctcccgagatcggctactttttttcccttgactcacgaggcttgactcacaagagcagcatcttcccttataaaccccgggcctgtgtctaccaattgccctatacaagacacacatggttctaactacccaatccgccagcatggcgacctccctcgcccgcatgctcaagggccaggtccgatgctactccgcaccgctggacatggccattccagcctccaaacagcgctacatccccacgaccggcacatacccccagggcttccaggtatctggtacccatgtgggcgtgaaggcctccaacacccgcttcccagatctggcactgatcgcctccgatacgccatgctcagccgcggcagtgttcacaaccaacaagttccaggctgcgccagtgcaagtcagcagaaagaccctgcagagccgcaaaggcgatggtatccgagctgttgtgatcaactcaggctgcgccaatgccgttactggcaagggcggcctagaggacgcagtgcagatggggaggaaagtagacgagtgcagcggtgtcgagaacgacagctctctagtaatgagcaccggtgtcatcggacaacggtaaatgcaccactccatctcaattgcttcacaacttacccgaagaaaccccccataactaaccaacaacccacccacccagcctcccgatctccaagatcctcgaccgcatcccaacagcgcactcaaccctcgcctcaacacacgaagcctggctcaacacagcccgtgcaatctgcaccacagacaccttccccaagctcctctcgcgcaccttcaccctcccctcctccccagaccgcagctaccgcctcgcaggcatgaccaaaggcgccggcatgatccatccgaacatggcgactctgctcggcgtactctgcacagacgcggcggtcgaacccgcagccctgcaatcgatcctgaaacacgccgtgtcgcgatccttcaactcgatctccattgacggcgacacgagtacaaacgacacgatcgcggtgctggcgaacggcgctgcaggcggcgagaccgtgcgtgcgccgggcgcgtctgccagcgcggactacaccgcgctgcagggtgttgtgactgatttcgcgcaggagctgtcacagctggttgtgcgggacggagagggcgctactaagtttgttactgtgcgtgtgcgcaactcgccggattatgaatctgggcgcatgattgcttcgacgattgcgcgttcgccgctggttaagacggctctctatggtaaggatgctaactggggtcggattctctgtgcggtgggttatacgcagggtgtggctgaggggactgttgttcctgagcggacctctgttagcttccgtccggttgatggaagtgaggttttgaagttgttggttaatggtgagcctgagactgttgatgagcagcgggccagtgttattctgcagaatgaggatcttgagatcgaggttgatcttggtggaggtgaacagggcgctgctggatgcggtggtgaggatgctgtttactggttctgtgatttcagtcacgagtatgtgactatcaacggtgattaccgcacttaaaaatagatgtattccagcatttgcagtggacattatcgaatcgagggagatttcgggattaaaggcctttggaagtgagaatgcctatatttacgaagaagagccgttgaaatgagcatgtataaatatgaacgatattgaggatcacggcaagttgaatatatgattttggttttttctagacacatatggttacaagaccctaaacagggcacttttaatcgctgagcaccgtctatcgagtgagattagacccatatgattctacacatggacgacataagacgttgacacatttgtgtcgacgtgcagagactcctagataggggacctcgggacgttcatcggcaagttaatcaacccgcacgactggatatcaatcggtatagttccaattcagccaaacagacggcgctgatccattcacccaaaaagtataacgtagaacggacagggaaaaaaaaaaacgacagaaaagtaaacagagaggttgcaaaggaccggtgtgatcctatgtcatgctgctcgtgaaattacggacagtctcgtttagctgccggggacgaggcccttgaggccagcgccaatgtcaccctcacgggcggcaatttcaaagtagccgtagatgatgctgtattaagctgttagctgagatgaacatatttgagatgtcaaacgggataacttacgtaacggcaagaagaataccagtaccactgccgagagcacccataaggtcggaggcgacggacaggccaccaatgcaggcaccaccgaaagcagcggcagtagggataacgcgcttcagctccttgtacatgctctgctcacggtgaccagacatgacaagaccctggtccttgagctgcttagcaacgtcgcggggagcggagccggaaacctcaatccaggtcttggagaagagagcgcaggcaacaagcatgaaggtaatgtagacagcggtgtggatggggtcgagaagagcctccttgaagttgagaggaggtgacatgtagtaagcaataccagaggcggcgtaaagctgagcagatccctcacggggctcccaaactccaaggagctggaccaggatgttctcagagaagcgagagtacagcatctgactgatgaggaagatgttggagcacagcgcggactggagcatgatgggcatgttggaggtgtagaagaggcggacggggtacgagccgcgcatgccacgctggcgggaggacttgacggggatctcaacacggaagccctgcaggtagatgacagcggcgaagaccagaagagtagccaggaggttcatgacgttgggcaggttctggcggtagaacgcctcgtacagggcgcgctgcttatcgggccaggtcaggagaaggtggaacagagcgatgatagcaccctcgaactcggggccacggccggtgttgatggtggtgggggagaaagccttccagacaatggactcgcaaatgttggtggcaatgaacagggagataccgctgcccagaccgtagcccttctggaggagctcgtcaagcagaatgacgacgagaccggccacaacgagctggacaatcaggagaacacagataccggcaccgaggtcactgggctggccgtagagaccagtcaggacgtaaacacaggcctggccgaatgagagaatgatagcgaagagcttctgggcggtctggtagagctcgcggtcggtcttcaagtcgaggttgacatcaatgaggtgggtaccggcaaggagctggagaacaagttgtgtcaatataattatcgcaaatggtgataggagaaagttgtgaatcgcatacctggaagaccatgccggaggagataataggggtgatacccagctccatcagagtaccccggttactggccagcatcatacggagccagtacagggggtccgaagtgtcggaggagacaataccgtaaagaggcatctgactcatgaccaggaagatcatcaaagtcaactgtaatatgtttcaattaggattcaagccgacttcgcgcggagacagcggattcagggcgacatacaccagtccacatcaacttctggttgaagggcaccttggtctcaggagctgccacctccgggaggaggggcgtaaagggcttgatcaagtcaaggaagcgtactatagtcctccatcagcatttgaccatcaattgagggtgattcgacacggattgttgcgattgcgtgcgcgacgaggattcggggaactcacggccgctcatggtggctatcttcctcccagtccgttaaagaatcaaagaaagctggagtcgaaaaccagctaaaggaatggaaaatattaagagaaataaaacaaaaggagaaggaagtgaagttgtcgagaagatggggggaggagggaagaagaagacagaagaggttcgctggccacttttcgcttccgcgctaattaaggccacttggtcttcgccgcaacaaccaacttggtgactcaaccagcacaagaacgggatatttggaggtaattgcacggtatgagctctaatatgagctccaattcaatcgtccagaatcgttttttttttctgctagtctttcaagtccgacgtgtgcaccccaaaaaggagggctccaagctatccccacactccagaggccacggtactaactacgcgatcggagggtctacaacatatggggtaattattgggaataatattggtatccatgtccaaataaaatattcctactttcgtcctttaaatatataccagcattctataaagagtataatatggccaaaagaaaatctttcaaggtccaacgagacccaggcaatcatcaatgaccacctcaagctctcctaatcgtgtcttcaggccccggttctcgtcttgcaggacacccatgacactccaggcctcggaagcgggcacgccgtagcagttgctgcaattagacgcgttgccgttaccaccagtgaaagagctacctaaacgagttgaagcaaggcccttcaacacccggtcatatgccgatgagcgtgcaggcggtgttgcacttgtgacggcgaccaggttcttttggattgtaggtgttggcatcgggcccgtcggcgtagatagggcgatctgcgacatgttgggagacggtgctgtcagcgtggacgtgggagactcgacaccctcacgctgcgagaagacgctatcggcaacgctctcgtccccggactcaaatcccgagtcactagtgaaggtgctatggctagcacgttttcctccgcgccgaggagtttggagcgccatggaaggctcgtcgtcatctggatgcacggtacgaattgcacaactgcgactgcgggattcttccgcctttcgcacctgtctctcttgctccaattcctcggccatggcctgcatggctttctcttgatcaagcaccttggcggccatgccgtccagctgcatcttgaggtggtcgactctggcgcgagtctcttcgagctcctcctgcttttcgttcttctctgccaaggcctggtgcatggcgaaggtccgctgcttataggcatcctgcatgcgtcgtagcaccttgtcggcgtgatctcgtagggcatccagcgcctcatcgttgggatcgtccaactctggtagtgaaagagcagcagtgatgtccagattcaggaactcatcgtctgctggttctggaaagttgggcctgctcggttgtcgccgcaggccgaagaatgaaaaccgattcgttggggttgagttctgcctcgtatgtgacatggatggtggagctggacgggaatctaatccggtcacgtctgaagcactgttaggccccattttcagccccaactcgactggatcagatttcccctggaaccaatctgacaagatcctggctcttgcttcaagcttcttcttggggaaggtttccgtccagggggtattcttcggacctgatatcgcgtcgtcgatgccctgttcaaatagtggaggtcttgcaatatattccgtgtttgcccgacgatgtgaagacggattgttaaagtgatttgaggttagacggaccgacgatcctgggggtgtcaaggcaacggtctcgtgaggttgagtgccatcggaatgcagggtgacaggtacatgggagagatcggtagacatgttctgaggggttatttcgacagcacaagcaggcaggatagaaatgccacgtcgattcaggcccaatatggcgtgtgcaacctggggtatctgtagggggagaggtatgaaggctaatcaaggacgaaacagacccctggatggtattcaaggtcaaatgaaaaagggtataggtagtttcagtgaagtatttcgtgtttcacagtgttgagtctttcgtttttccagaattcgaaaccaaaacaccgaaaaataatttgacaggaaaacaagaggctggggtgatggaaatagcggtggctgaacaggagctctctccacctccaagatccaccacatcttcctttccaatctgattaattacacggactcccaaattagcgcctctaggcttctttcgagttcgatatcgtcaattttcccgctcccgctgtgcatggtttcagctgcacgaggatctgcgtcattgcacgttttctgcaacctcccagcgtcatggctcccaacggtctgaagcatttatccaatgccctggcaacgccagaccaactgtccaactcttcatcctcaatcgacaatgtcccgtctgatctcgaaacctccattcgttgtgcgggcgcacagctcactcaggctgccggaattctcctacacctgtcacaggacgtaattgcccaagcgatcgtgatcttcacgcgtttttggcttggcgctgatgggggtagcttgcgaatctactccgtcaaggtaagaagagttcgaggaattctaaattggccttctgatccactaaccagagtaggatgtatctgccgcggccttgtacctaacagctaagctttcctttcaaccgacctccccacgctccgtcctgaatgtctacacattcctcctatcgcaagatgcatcgcccttgtggtttgtgagacagagcggggctcctggaagccccccatcgcccgagacctatatcctgtccgagggaggttaccagtccgcccggctagtcctcctccgcaccgaaacggttatcctccgtattctcggctttgatacacatgtcgctctaccacatacgattgctttgacgtatcttcaaaccttgggtgtcacaaagcccgctgtggctcaacgtatcattcagcacctcaatgcggcgctgctctcaccccagctcctttatgtcacccaccaaccaaatgccctggctgtggctgccatttacctcgcttcacgcgaggaggaggtcaagcttgtggatggcgagtggtgggaagtctttgatgttgatcgcgaagagctcggctttttggtcgtcggcatgaaaagcacagaaggctttatgcgggcggaggtcagtcggtggaagaacagagctattccaatggtagtagatgaggtggatgccgaaattgagcgacggcgaatgatggaggagggcgaatgaacattctttgacttttgctgagaacatcagatttcaagatcaaaagcctactgggaaggatgttctggtagaagctacccagctatctaccaaataatataccgcaggatcgcaggaacgccctatcagcagaaggcctcacggctgaagacttcgcgagatcccggtccgcacccagaaggaattctcgcaacacccgacaatagacggcctcgtctctgcaagtgtggccgaatatgccaccagaagattggctgttccacggatttggccaatcaccagtgaattccgcggcctgtccagctgaacctatatgttacatactatagcctctctcatggctgtaacatcaaagtagatgtatgaatgctatttcagaactcaagtgcaagatcgctaggtaaaattctggtgataaatgaacgacataaatgcttccatcctactccatatgctccgcccgagaaacaccctcgacaggctggtgattttgtcctccaatatgcgcaccacattcaggacatttcgctagctccatcggcataccacattcgccaatagcaaactgaagaaagaacagaaaaggttagctatgtatgtctctaggaagaagatctccaatattccgcaaattcaactcaccggatgtccgttgatacaattgtaccaatgcccagagttagttgctatgcctcctcgcccgccaaccatggcaatcttgatggacgcaagttcctctggcgtaatctcctcatatcgatcctcttcaaagagacgattcatttcctgaactttctctcgaagttcctcacaattgcccaattgatcgcataaatgcaaggcatcggcaaggaactcacgcgccatattcctgcggttatcacgcgattctaaccccgtactcgcccgtcttttcatatcagtctcatcctttccgcgtactggacgtgtgcgattgtaccatccgagcagttcggatattttggcaaatgcgagggttgccgtgatgacaatacgggagaggctcccacccttggcttggatgatcaagtcttggcagtcctccaggaacggtatcgtgagctgattaagctgaacagtgaggattgtctcctcaaccttcgcgtttgaattcaagagtctgaacttatcgtgaagaacgaactctcgggccctgatagagatcaatcgtgccctaagagttatctggttgtcaggtctcggcgtggatattgtcagtcttccaagctggctggagacggtggtagcttcttcatctgatgatttctgacgcaaagcgatagcatccttgagccgcttggccggttgatgccctgtgtccatcattttactgaggactgcagcttctttcgcaagctggacgaaggccctatatctagtgttaatctgcgctttagtaaggctaattggcctcgccgttgtgtctttggcaacaatcgcatctgcgagggtattcagacgggaatcaagggcttccaggtcgatgcgtcctttggttaagaatcgcttgcatgtttcgtccataacagctcgattgatgacacggttgtagcgttttgttacaaactgacgaatgggctgcttgcaatcagggcacgatggtatggtactagcaagagaagcagagacatcccgaaggccgtcgaacttgccagatctgtcccttgtgtacacttcatctaagcggacaagaccatcgaccgactcactggtaaagaaatggccgcagccgagcacgacaattggactctcgtcgaggttgatttcagaataacatttccattcaaggaagtcgacacgagcgtctggcttgtcaccgcattcttgacacaggccacttggacagtcttctccgcaaagactcgggcactgatgaccgcaatcgaggactttcgtgcatcgctcatcgcacggaagtcgatcacacggtgctgcacatggcattgagtaggaaccttagtgaggacaaacccaagtgcatgtctcgatacaaggtgcacatgcctttccgcaggtggaggcacaagttgagtgtgagcatcgaacctttttggtgttagcatgatataggaatagccagggatgtaaataagagaaatagaggaatctaagctcacctcgcatttggcttcacaattcccacagccttcgccatcatgacataccttggggcacctatggttacagataccaagtggacgatcacatttctttgtgcatgtcggatgctcaaacgacactacaccgttttcaccttccttcaagcacttcccacagacacctccacaattgtgaccacatccgagaatttcggtgtatggctccgtgcaactaaaaatctcagacgtaacgtcaacaaagcaggcaagacggagaacatagccacacttggtaatgaccttgtccactttcacgtcgcacttaatcgacgctagattatgcatctgatggcacataagcttctttttaacatggccacaaggaagcgtcacgtcgcggatttcaaccatacaaagaccacactcttcaccacagagcttaggacatacatggtcacaggtcttccgaattcgagaacaaggcttacaacatacaaagccatagtgcatgaacgatgaatgacattttgcctggcaccggtggccacatggctcgagacgacgggtgcataggatattacatccaccttcggggctcttcgtctcgaactcatgaggctcagagcagaggatagatatttcggggtggcgggggcagcatagggccagttatgtacccactgcgttcgttcgtgtgagctgagcgtgaatatcagcccacattgggacattgaggtaggtctcggaattcccgatcaggtatatcccgtactgtgctcgactgaggagcatattgatacggttctcggtgcgaagaaagccgacttttcgttctaagttgctccgaacaagggagacgataatcactttcgcctcttcgccctagaaattatcaacggtagcaagacgcagcgtctgaaggagcgttttcctctcaatggtcttacgaggtcctacttaaggtgtctcttccgtatccaagccgagcccctcggctgctaaggcctccaaatcccgctcgctaagacatatttcgaaatctttgctcagcgataccctaagcttccgcagttgaccggtgtagggagtcagaaaagcaatgtcattgctgctgtactctccctgtcggacaagatgccgcacaagagcggtcgccatgtcaacctcccaccgattgctatgcgatttcacacgtatatcatcttcgctcgtgtcttcatcgcgtcgatggtccagccagaagacattctctcgcattccgacgacgttaggtacgttcataacgcttttataatcttcaagctttggatagacacttcgaatcagttgcgaaatctcgggcctcattcttcgctatacatagagttgtgcaacaggggcaggattgagccccggctcgccaacagcacgtctctcaaattggctccgatccagctgccaggctttcccggatgacgactcaaggctaagcgagtaattttgaatctgcggccgtagctgccggtgatcgccaatctggatgaagtgctccacgcctggcataagggatgagattacatgtgcctccatcacctcggctgcctcttcgcatataatgactcttgctcctatgcggcgcaatgtctcgatatttcgcgcaagggatgtcgtcgtgatgcctacaacgtcggcttgaatcagagctcgtcggtttatttcttcatggacggcgtgtatgttttcacgcgaacgctcagcgctattgatagcctcaaacagtgaggcactctcttctttgcaccactgcttaaaccagctctttgcaagagtttggcgttctgacttcgagaggtgatagatatttcgctcggcagagcgtgtcaggcgtgccaagcgctcatcgggctcatccacatcctcagttttcgagcaattcaacgatttgactcccagccagttcaagaggggatcttcaatgaccagtttgtatccctcgtcatccatcaggtccaattgtctgtgtatggcgggccacttccggcgcaaaaagtgctgcatccctttccaggtcgggccctttcgagactggtgcagaggcttcatggaatagccggctattttcatgcattcctcaaggtcgctgtaggtttgtccgagtgtttgagactctactcttgtctttctgatgccgccgctaacaacgcgaaggttctttccttccagctcagtagcctgactgcggccgccaattcgtatgatcttctggatatcaatggcaagaaggtgcttcaagaattggtccaaggcatggttcgtgtagcacctgtcgttgaggttagccatatgatcgacggttatacatagaaaagccgctttccaaaagcgagcctttttggcccttttctgctgtctacccgacaaactgacaagaccgacggactacggccgcataaacggccgactgtttaggccattcaagatgtgtagaacaagaaatacttacatcacgatgattggccccaaattcgcgcttgctttgatggcgaggagaacctggacaagcttgacaccaacatgggattttcccgtgccaggtggcccttggatcatggcatattcccgcgtgagagcagcaacaagtccctgacactggccgcggtcgagaccagtcaaaactcccagctcttcgagttcaagagactccgggaaattgggatctaacttgatatctcgggctcgatctttattgattgaaaggaagggataagcaaatcctagctttcgggcatatgccggtggaggtatatcggtactccccttatccccattctggcctggcaaaatcaatttctggaatgccaactccccttcacgctgaacacgctgtaggttcttaagaatcgggacaaatgttgcaggaatgaggccatggaagtcaaccagtgttcctgggattttctcgctgtaaatttggccgaggagatccagttcttgctgtgaacatgtcgcgagcttcactgtaatgctgggcggatgccgattggagacaagggtactttcttgtttctcttgctcttgcgaggaacacttgactgtgacttcgagaaaaagcagtctttttcgggacccttcagaagtcaagaagcacaccagcgtccctacctctagtcggttagagtctttccaccatctggactgctcggcaagaggctttttgcgtagttggggtggtacagagaaggatactgttgcttcaagctcgtttctcccattaacgaagacatgctggacatgtgatgtcatgtagatatgcgccctggtatccttgtttgatagcttgggatttgggccaccttgccgcagtagatctcggagtacatccttaacagagccgaagatatcgtggcgcagaagccggaacgtggagtcaatgtatctcagcgtaggatctgcaatgaagtgcggctgagcaaagttggtggatggtagatattccgaatagtcactgacgatctctccctgtgtcggaagaatttgaatctctgagatttctgcaaggtcgttgtcatgtctgccaccaggaatttccatgtccattggaaatgtcgattgagctagtcgagtgctagtccttgaaacgctttcttcgggtactgtgggtggaacaagaccgcggagtgcgcttgctaccacatttcgcatgatttcgatcctgttgtcaagcgcctcgacgtcggccttggagcagactttggtcatcttgtggaccaattcgtacaatgagccgagaagtgcagtaaggtcatcatggaagcgtgcccgtcggaccctgtacagaagctgatacagggcactcaacagcaacttcaccatgtctggagtaacgagagtctgattgttgctgttttgctcaaagctgtttatcatgcagtgacaaacgctttccaaaaacccgattgctcgatctccattcgggccaccaaaggttgcgtacatagtgccaacaaatgaatcaacagagagacaatccaaaagggaagggtgggtaataactttgaaaaatggctcaacatagacaggaatatggcgatttgagtcgtggccggttgtatcgatagttgccagtatgaacccgtgtccatcaagattgtcatccacgaggtctctaacaaggaactgttggtcccctgtattgtcactgtcaagtatttcaatcgcccctgcccatagttgaagaatctcttctggtcctctctgagatctgacaccgatgaaattccttctcaggatcttcttccagtccaagtatcgtttccgggccgaaccatcagttgtaggatcaggctcagatccactagctcttgccgggtcatgagagaacttgcaagtcgagccgtaggtacaatttccacgctgaaattgcttgcagattttgtcgctttggttacgggttccgaagctgttcgacctgtctggattgctggtatggccttggccgcgcaatcgccggtttccacggccagccatgattgtataggcaaaataaaccttcagctagtgtatccaattacaatatgcttcgtcgtgtcagcataactccagcaaatgaagaaaatatatctctaagagaagtggttggctgaccggatgatcccaaagtaggtgatttgagcgagtagggaaaaggaaggcagttgatttcctaggaaattaagtagctggcaatgtaattataggcaataaaattcctgacaaacaatccgtagttgcaaatagcaaacaccaatatgcaccgcgcctagaatactcaaattatctgctgagcgacggtgaagactgacaattacactcatccccagcctacttcatgtatgcatataaggtaggatatagcaccgagaactaaaggctaaggatgctatagaatatgaaagccctataagttgacgtatagtacatagagaaattcatctgtaagaagagccaggaatttatacagactagaagtacaagaatcctcacgtatcttattcaaatatagcaggttgcaatatggatctcaaactacaatcttgcttgaagaagttgagatatgttgctttgaacaactttttctgatcaaaaaggatcattgtcttggtataataatcggtagagatggagatggcgtttgctctccttctattagggcagatacattagatagcccttcgtacctgatacagacctttttatatgcccaagccatgacttttcttctggcaaaaataaataaatatttctgagaaaatggaaggatgttgagctagaatagtttactagttaactccagatcacctgggctcgggaaaataacgttcttatataagcaggtaccgtcacgtggatatcagttcaaaatgacgctcacccgtggacgcggggcggatcatgtgctccaccgcttatcatttacccccgccgcttctttcgcatctctctcttcactttcacctgtgaaacactatgaatatcctacactctacactgtcaacctggcgggaccgcctggccccggtatcacgcacgtccaccttccgcaacaccggccaaatcaccccagaggagtttgttctcgccggagattatctagtctacaagttccccacatggtcatgggccgacgcatcaagtccggcaaaacgtgtatcctaccttccagacggcaagcagtttttggtcactcgcggagtgccatgtcatcggaggctgaatgacaattttgccggagatgcagggctcgaggatgagatcgtgagggatttcctctcgggcggcgacggcggtgaaggcacagtggccgacgatggggaggatggatggttgcggactggtggcggtcgcgacgctggagcagaccatgataaacaagaagctcggattcgtgacgtgcggaccgtcgatgaatctggaaatctgggcgagcaggaggaggatgatgacatccccgatatggaggatgaagacgatgatgaggaagccatcatccgagagacagatgatcagtcagggacaccgtgagtaccgttttcctgtcttcaaacttcaccttgccctcttttctaacccgtggcttgctatcggtccagatctctccgcacttacaccctctacattacctactctaacttctaccgcacgccccggctctacctgtccggctatttgtcgccatccgaaccgcttccgccacatctgatgatggaggatatcgtcggcgactacaaagacaagaccgtgacgttagaggacttcccgtggttcgagggcagcgtcaagatggccagtgtacacccatgccgccatgcctctgtgatgaagacacttttggatcgtgccgatgccgcgctcaagctccgccgcgacaagctcaagcagacgcagtcacgcgacgaagcggaccgcgttcttcgggcaggcggcggattggaaggcctggtggatgagacgaagaatatgtcgctcggggactcccaccacgcacagcctggcggggacgagtgggaaatgctgcaacgcgatgaggaagaacaggtcgctatccgggtagaccagtacctagttgtgttcctcaagttcattgccagtgtgacgccgggcattgagcacgactttacgatgggggtatagtttcttttaatgggatccagactcgtcttatccgatccttactttccagaaagctatacttttttttttggagaaattggactggggagtggctaggatctggcgtgctgctcccttgttcttgattttcgaaatgtgatatgcatgacatgatatgagtttggcgttaatctgcttttgggagcacggataatctcctttccccctttctgggttgcttttgctgtgtattatcttcgttagctttgggagttttcccatggcaattttactacgatctgtgaagattcctgagtaggcatcttgcaaagcgagataataacagagcccttgcatttttgaagtaagcccaagggacgaaagttgaactaataaggataggaaatagaaaaggccgatatatcaaatagatacatgtatggatgtttgtattgagatgggggcaaggctttgtttctgtatgaccattcttagtactcaggttcagtataatctcaaaagttatatacatgtataggaagtccgtttcacaagttaagcctcctgccgccgttttctgcataccagatatctaaatagaccaaccgagactactcaaaaaggcatacctaagacatataaaaagactaaaaagacttgtcggagaggagcacctggatagaccaccaagactacggccatacaagcggccgactatatagtctcaaagcggaaggtatacgagtgtgttcctattaaggtacgtgataccggtgttgggcatgaattgaacatcaatggtcgtcgggccaaaagttcctcaccagccttgcgtttagtcccagttataactggcgaacggacttcagcaaggtcagaacggacaacatccttatagtgtcaatcttgtaccatgacattccactaacgtacaatctcagtccagtttccgatgatcaacttgtggtttcctgcctgttcgatatcccaatgaagtttcacttgcactgcaaggtttacccaggcttgtgtcaggtactattgtcctcgtgcagtcgaccgcagataatcgataacctttgatacccaatagaacacagtgttaaatttagacatatcgaacgcagaggagaagtattgaaataggtcctctggtttttgcttcacagcgagtggtgctggagtccgtttggtatactcgatttccttgttgatttgtgtcttttagagttagcatttccatttcatctagatatcattgtttattattttaccttcatcctttgcaaagactcggatttccaggatctgcatgtgtctcggacatataaaaggctgctgttgaactcaaatgagttcttatttgcatgtggcaaaacttcggcaacaacttcttcaatcttgtccgtattgaagtgaagagcgtagattcatatagaatgactgtaataattgcgtgagatgatattttgctcatgattccgttggaacacttactttggtctgtaatgagtttggacctggcccaaacgttagaggtacacggactgtctgtaccgtgtactcgaaacatgaagctattcagagcctcatttccccatgcaaatgagtatatgcggtccgtgtgtagcgttgaggttgtgtgacaccgttattggctcgtgaaagtaactatggttcggatagatattgcggggaagtttctttgtgatgatgacgttggcttgttgcctcggacgttcagttccctgaatgtcccgggtgtctccatataacagttggcatctttactggccttccgaattgtcgtagaactttcaggagttgcataactgttgacatgcagtgcatgcagggtatgcgtttgtctctctgtgtgcagactgagctctttgagcctttgtctagcttggtctgtttgtcatatatcgctggcttatataccagcttctttccatagtttcatcagcacctcacttcttcttcatctatctctctctctccgtagcctcaacaaataacctcatcgctgtcttcaggagtatgaccgtatcttcctttctggagccagagacggatatgtgcgttcaactctcgtataacaagtcttgcaaaccagtggcggagagggataagattgacccagaggtctggagcttctttgctgttcacaagtgccgacacaggttgatgttgtaaatcttcgaatttcacgaactctggtgctttgatttggtcaccaattgggctaagggggagtctgtgaagtcgaatagtgatcgcatcatgaggcgcttgaatatgtacaagcatttctccccactggaactattgaatttaacttaatagaacataatagaacttgaaaatcaacagtatatcaaaataatatattccaattgagagtaatatcaaaaacaagtaacaataaaccacataagaactccgaatagtgcaaagcacgcgtggacgcccaaagtgaacaaattggacaaccatccgcagtagctggacaagagccaaaaagcatgataagtaaaaggtcggctctcactgagcatagaagatacatgtaatctggggtgagtacaccagccgacgtagacaaattataaaaagaagagaaagcaaagaatacagatgtaaaaaagcaggagatacacaggtccggacaatcattagatagaccatgtcgctgacgatggtctatccgggtcattttcgccattctttatcgtgttcggtaaatgccacagcagctttagttgaagaaagccaagataacgggaagagccactacaaggacggaaccaggaagcagggcggagccggcgttgaagacgggctggacaggcgcagaaggcacggaggaaggcgaggccgatgcggtgggcgcgggacggtggatcagaggggtggaggagggggcccaagcgggcggggcggtggtgagtggaacggagatgggggtggtgaaggtggcaggagggacgatcgtagggacggtccaggtaggagggtgggcagtctcaacggggggaataacagtctcaacggggggagggatgaccgtggtggtagtgggcacgacaatgggaggctcggggcaaggatagccgtcctcgtggtggtgcatgccattgccgacgttgacgctgggcccgccggggataccgacgttgacgccggcgccggcggcttggtcagagcctgagcctgggccgcaggggccgcggtgggactcgtggaatccggcgccggcgttcacgaagggaccgcctgggatgccgacgttgacgccgctgccggcggaggtctcgctgttgcctgggccgtggttggtggtctcgggggcctggttcatcatttccgggaatgggagagcgggcagctggggagcggagagcacgttggcagggccgagagcaaggaccaggcacatgaggccggagaagttgatagtagtggagaccattgttgcggtagtttggtttgatttgttggtttggaagtaggaagatggatgttgattaaataaatccgaagattgaaaatgtcaagttggtaaagtggttgaaagagagttgagaaagagagagaaagcgaatgactgtttagagactgtgatgcttgatgaagaacggaagactaggcgtgagcagggacccttatgtactttttggcctccaagcagagtatacacttgaaaagtatggggatagagagccaagggctctatccaggaccagataggaccagatggggatatttctgcaaggcacgaactaatgcttggtggcactcatctaaaaaagccacaagggcagtgatctgcaaggtacaaagtcaacggccgccgagaaaggaaatcatgagagacatcaggtcttagggggcctggaaccaagtcattggaggtcattggaaattagcaagcagcatggttcgatagtcaggacctgcaggtctgtcgagagacccgatatgccctgggcagcgtaaagcttatgcacgagctctaccccgagcttctgagctgtacaattgtagtagctcatgtaggacaggataattccattatgcagatggagtttggagaatacgaaaacacgtgcatggggaagaaaggtacctaataggtatagatgcaagggataagccaataaagcacagaaacattaactgcaggagacttgccaaggaaccaatcagggtatgggattaaaattgaatgcatatacatcacacgcaaggaacaggtgagtccaaatgcaacttgcgactgttgtcaagtcaaacctcaaaaacgcagactgcaaaagaaaatccgagacaattggaaataaatgaggttatattgcacatatcaccatagatcataatctcataaggtatatcgccaaaaaggagcaagaagatataaaaaaaaagttacagcatcaaaagcatatactccatgaaaagaggaaacaccaagagatccaaaatagacatgggatctatcacacatcacaaagatccaagcgtagatgtatgtcaaatgtgtgcttccttagacatgactcgagttcgatattccaaatgcagtgccaaaattagtagatttcttgaatttgatttcaggttcttcctcttcgcgagggaactcagactcaggatcagtctcattaggatcagccgattcacccgagcccagaatatttttcgcctgatcaaggagtttctgatcgagttcattcaaaaaattggagtcgtgctcctcatcattgatcagaccgagaggcccctggagagcgggatcgtctggcacatccggaaagtaggagatctcattttcggaaggttgatgaacgttcgtcgccacgggcgcaaatggagtctcctcaacctgggaggcaacctcgaggggggtcccctcctgggtggaccgtcgactatcatcaacgtcgatgatcgccatcggggtgtgacctgcatggcggagcaagttctcattgggcgggccgagctctgacagcttcaatttgagactgtttcggtgttcgatgggccttgcagcggttgaaggggcagtgtcagggggggttaccaggggcgacggggagggcggagtgatcacacgagctaccacggccggtggcagcgccgtggacttgagcgtgatgccatccagcgtgctgtcgagtctttcgatcggcaccgggtgactcggcgctgcagagcggtctacttgtcgcgactggggggaaagggcccgatcaagggatggcgggtttccattttcagagatcggcgatagatagctttggtctggagattcatgatcggagaatactcttgttggtcgactgtctggacttgtcccctcccacacctgagctgcgaagcgatttgtgttatattgcgatattccacctgcaagcacaagcttggccgcttcagatcccaattgatttgttctgctcccttgacccctcactaactcctccaactcggcaattttcgatcgcaatagcgcccgctctttctcccacaactgtcgctcctgcgcgaacaattccctctccgtctcaaaattcagccgttggctctggagaagcgcccgcgattggtcgatataggaagtatccatggcgaacgaattcacccgcgccgagtcctggaatgcggttcggccgtagcctgatatgacaggagggaatgtggctgaaacggattttgtgcgacggataggggtttcggtcggagagaagcgtacttctttgtagagacttccgtggccgtctagtaatttggtagtcttcattgtgtccgaaatgtgtttttctcacgatgagcgcaaatcggcagataaggatctattagggaatagacgtggacatgcacgatagtagcgtggacgatagtaacacgataatcacaatcgtgcccaacctgcaacgcctttcccacgttgaccagtggagttcctagaagcggtcaatgagctcagagcactccgacggaaattcatgcgaggttcccaatatggcacatgtcaggccttgggtcacgtccgtagattaagatggtttgggtagatttaggatttgggtagctttcaggtacgaaattcccagatataagtaagaaaagatgaatagactgactcatgaaccccacaaattccggggaaatggaggttacagtggaaaagaaggcaaccagcgaagacagtcaacggatccgaccaccgcttatgacgtcaaatggactctaataggaaatgtcattaataaggtgggagatccaggtctaccttgtcgtttatatatattgtttaaaggatcaaataggggagtgagagtgaagtaaacatttcactccaaaatgtcagatatatatatatattgcagagggcaagagcggtatgagggccatcctatttatgtacttgtaagatcagcaacaaagaaaattcaaggtcagattctattgaggtcagtttattagactgtttgaaatgagaaaagtgatttgtattaactcgaggccatctatgtgtgtacatatgtaagtataatatcaacaagcgcagtatatccgtaaatgtatgcccagaattcgccccctgtgctgaaatagtaaaataaacgtggaagaatggagaaattgaaaaacgccatttgcgccatatgccacattcgacctttaacatgcagttgaccagtataatccgcgctcagacgtcatggcgcagggctagcagagctagtgaaaacaccaagtcaagaatcgaggtgaatgctaaaagatgtcaaatcaagaaccaaaaattcaaaaggatatataggaaaaaaagaaacaagggcaaaaaaaagggaaatcagcaaatagacgaggcggactgtagtcgacttggaaccaatttcttcttgaaatccaaagaccaagccgaacaccccttaatagaccgattatcctgtctcatcggcgaccgactccgccaaacaaactgctgcgcctcatcaagcaaatgctgatccccattcggcaacggatagaaactaacgtccttacacaacgcgccgaagcgcgtagcaagatcaaacactccccgagccgtaaggtccctcccgcccacattcgccgacggataataataccgcggatcgaggtaaagcaacacactattccagcggggaagtttctccgacagaagccgggccgcggtttcgtattgtttgagcgtgcgcttcggcacgccggtctgcgtgtgcacgaagaagaagacctcgaagccgacgctgcggatgcgggcgcgggcggttgcgctgagcgtgtcgaggaagtcggctagtcggtcgagattgaaggagttgcggaggaagagcgtgtgtgttgagtagaggtagtcttcggcttcgtcgtggagttgtcggttcaccgctagtaacttgcgtgcggtgccgtcttcgccgacccagtgtggactcattgataaggcgcggtattggccgcgggatgtgaaggtgttgccgtgatcgcctagtacgatcattggtttgctgactagatactcgtttgggacgtcgagtgcatattcgtagatcttgagacggagttcggctgggagttggagaagccgggatggtggtattgatggagtgaggttcgtcatatctgcttagaaccttagaagaatgagcaatagatgaattcgagctttgcgaaatgcggctgttaatcccgtttgaatggtggtaccactcgggtgtatacgctatagatgtgtcgccaccgtcagaaatttttttttgatcggaaaaagtcaaacaaaaatagagatctgtacaccgtacttcgatgataagatgcatcagaccatgaccccttatatgaaatgccgagacactctcggcattgtccaggccgatatacttcgccgggtgttaaagttcggcgaatgttcaaagtggtttattaggtctctacatgtagttatctagttatatacgtaggtacatacagggctgttcctggatttctgaaccatggatacatttgcaaagtttttatataaccttgaaatccttaaatgggctgatgatccttgaccctgttgacccacgtattagtggagccgatgagtttttacttcagaactatgtattggacaaggagaaatggagaaatctcaacgccaagtaccgtccaggaccttgcaaatgtacacgtgtaatctattggcccaagtatgctgttcttggacaacatgccatgggcgcatctgtcgactgttgagtgtaaggagtgttgcaaacgtggcattttaacattccaacccagaactatatcggaaatccattgaatcacccactacggccaagtcaaaaaagccgagtgcccaaaagatcaagacgcaatatatttgctatagaaaactgttcgaaaataccatggacaatcaagttccaaacccgatcatcgctgtctatagacacccagcgaccaagctgcccgcagaacagccaggccccaagccatgccaatactgtctcgcaagacattcaacttgctacccttaacctccctccaacccacaggcacctcagccacagggatccgagcgaactcagccagcatgagcatctcaacgtcgaagatccagccctcggaatgcatgtacggcacaatataaggcaacgcactacgcgagaacagcttgaacccgcactgcgtatccttgacagtagccgttttaggaggcgtcatgagccacaggatcagatggaacgagtgcatcaagaagttccgaagcttggatcgctatcgagcaagtcagtaatccacgcaaaacatcccactcagacatcaaatatcataccttaaccacagcctcgctgccaaccatatgcgcccgcgatccaacagcaaccgccctccccttcgcatcctccacatcccgacaagccccaacaagcttccccagatcctcgaacttgctcgctccatccgcgtccgcaaagacaacatactgcccacggacatggcgcataccgtgcgtgaccgcgccgcccttgccgcggttatgggtcaagttcacgacgcggatcgtgccaggcgggatatggacgccctccgcagcctgtggtgtccacggacccgcgtgtcccttgggatgcagagagagctggtggtcgcgcgcgaaccggaatgcgacatcctccgtgcggtctgtcgagccgtccgagacgaggatgatctcccagccgcggtctgaggccgggcctgcggcgtcgctggtggtatctccgttcggcttgcgtttgcgcatcgagcgcgtttcccttgttcctgcgctggagttggcgatggcgctggctgtatccccgtacatgtgctccaggtagttgacggcttcttccagcatgccggttaaccggtcttcctcgttgtaggctggtacgacgacggacatgaatagctcggctggtgcgattgtgtcggttgtggtgggtttgtcgccctttttggtgtctaggatttcgagccagcagggtaggggttcgggatctgtgacggatccatctttggcgagggttctatacttcttttcttctggtaggggttctcgtggaaccggcgcaacgaaaaatatgaataaagagaactatgaaatagaatgaagaattgacaggtcagtaacttgcaattggggctgcgcgtgtccggggtaccaccgcgcgatctggctggtacaagcggagtgggggaaacgtggactcaccaggacaaacagtcccagcaaactggctacggaagcaatgagtaagatctggactgggatttccaccacagtattgacgcattggcgacagacctcgccccaagctgccgccattgtggagtgacgagctgaacgtcagatgcggagacggaagacggaacagatgcggaatggggagtgagtgatgccggagggaggcaagcacttaggtccgagagagaaagggatcattcatagaggtaaggcagaatgatcctcgccatttgaacatttgaagagagagagagggcagaagagagggggaggaatgctgctagttgataatcgccagcttggccttttatcggcaacacgcaagccgatatggaaaagatccacatttgggagccacggttcgtagacactaattaaactatagttattggaacttatattggaaggtatattagaaggtatacagatatattaaaagatatcttaatctattttaatctattgttctgctctattacaattaatgtatattgtccacgggtagctcatttggaaaagacattgtcgcatacaagacctgattcttgctctatcgaatggcgcagttcctcgtaaatatgcgcactcgagatgtacctcaatggacaaagttagagtggcgcctctagcaagacatagcaaccttacagagattggcctagggagaacaggactatggtgcctgaactctctgagcatgctgcaatccataagccactaaaaaggccattgaaaagtaagtaatggatatggggttaaagaaggagaaagtctcggaagtcggggagaaggacaagggggtgtatatactatatgcgaacacttcccaaataggaaaggggactgtcactaaaagcttccatatttccaggtttcattcacatacttcccttctcttatcgtcttatttcttctctcaaacatttttcttcccctgtctcgtgtcggttattctctccacactcattcgtccaactagcaagttcaaacaacgcattgagaagccaaggcttctttgtaatagctctgaatgtgccccttctggatagaaggagcacgcaacaatccaagtccaggaagcgattgaagctggagtcttgtttcccaacaagtcagattcaatcacatttgaatgtcgtccaatatccggaaactgatcaaaaggcctgcgaaagctcccggtcattatagaactggacggacagaaacgtggcatcccgggacaggctatgttcccaatcatagtgaaaccggatggacagaagcaagagcatcccgggacaggctaagttcccataaatccatggcaatcgatgcaataatccggagactccaaacggtccagtccttggatagtggtgtccaggcagaggcatgccttccagggttggtccaagaagtaatctgatagctgatatctgtcgtgtagtcgagggcgactcatgaatttcctgtctggtaataacgaaagaaaaggatccactctctggcttcgtgtacggaaagggcccaaaagatttactcaagaaggcttgagcacttgttcgaacagaagaaaagaagcccttaggatcccaccagccccaaactgatccgccaagacgcacagcctacgccataacggaacccacagagccagcagtcacccaaccgcgttctcaaacctcctgcatctcctgatcggaggggggtgatgtctcagtgcctagtgagtaagggttgccatagagggaagcgggtgattcagccattggcgcaaattcatctgctaatcgggtgggtgtgaaccgtcgcgtctgatcgtatgtcatccagcgggtgtactagtatgagatagatggtcagttttcaatatgctaataggggcagggaaacaggacagggaaaacggacagttgcgatcctcactccaagccaaagacatcgatgccttctaggaatcactgtcgaatgttcttctatcggtggtctgtcgtcttctgtaggagcctcctcgaagaatccttctgggtaataaacccggctccacgcctgtcctctaatcaaaaagtcctccggtagctgttggatagtcgagtcgtcaagaagagggaatgtttcatcctcgatcttcgaaacggtcgtgtcgggacgaaacaaggtgtttagataacttgcaagtaacgaccacggaatcagcggttccagtcgttgtatagcagccgggttgagcgtcagacaccagacaaatgccatagcgatgtgcacactcggatacatgtttggatccccgatttggccgagcataacgatcaacgtgtgaaacgtgagagagctcgcccggaatgcgagctgggacgaaagatcgttgtatacggcgtgcataggtgtttttgttgcggctgtacttgatgcccacttcattgccgctaggcgatcctctgccgtgggattgcgcgacttcaatttgaaatctacttccaccgcccctttcctcccatattggaatatcgcacagatattgcaagagatgagttggacagcttcctgcccctgtcgccctacccggctaatttctttacggagagtagcaagaaagactctcgctcgagaaacaaattcctcaaccggagcttgcataaaaagcgcaccgtgagttgtcacgaataaagtactcaaacttccctcttgcatcttcatcagaggagcgacgagctgggtcatgctatcgaaagcatttgggaatgcgcgcacactgatcaatgctttcgtgtagtgaaaaaactgctgaagaacgtccgggcgagctaaaacagcaagatgatgctggatgcggccattttcttggtttcggtcctggctataccaatacctcgatacccctgcccagaggtcacggtccttcttgtcgaattcctccacggccatccggtaccgtgccaagtcacctaaacactcaatccaagtctccctgaaatccggcacgctttcaagtagtagtgttatcatcgagtaggagaggtagataaaatcgagcatatactccatcgagccgggcagtttctggcgcaatagctctaagaatgagtgcacgccataccgccacatacgcgccggcatagcgtacttatcggctaagtctttcagaacaggaccagctgacgggtgttgggaggcgaggaaaaagtcatggtgttcgtaaagtaatgttcggtgtagcgagacgagcgtttgccactgaggctgtgataattcggcctttgattgcgcttgttgtctgtcgatctcaatgcacttcttttccaccatgacaagtccggtataaattccgcgcacttcgttgatcagttgctcctcggtgatggtgtgggtctccggttgcctaaacatttcatgaggctttggttcctgagtgactgcctctccacccaccatcgccacatttcgatttgatatttgatcattttctgtgtgccgtgattcttgcacttgcgcttgcgtttgcatttgggtagtgtggcaagcattctgaaacccggcaccattttgactgtgcacagcagtgggtgttgactgtgatctttgcaattcgggacgtgtcgcaagggcttgaggtaggttcggttcttcttcctgcctgggagcactgatctcaatttttggatctgtggggtgtttattgatacatcgaggcacgccggacttcaagtgttgagaagccgaagccgacagccgccgaggatctctggagacccggcgacgagatttgccgacatggcctacactggtgcaagcgggacttctaatagctcgcatgccatgactactgagcgtttccatagtgcaatcgtctgctaggacgcccgtggactttggccgagcactggatatcggcgtggtgatggagcagcagccgtgggtactcattgattcagagataagttcttccgacaatagtcttttcaaagttcgcctggatgaacagtcaaaagataagtaacgacagcccggtggtcgcaacatacctaggtgacacgctacggacaattccgcctgagagttttgttttggcatccaagaggctataaaaattgcactgagtcggtcttgcctccttacggcacagtggcttgtcggccatttcaaccatctagggagaattaggttatcggttgcaccttgggagtggcgaacgcaccaaaaagagagatgttcaaatttcacatgttgtcatgaaggaacagagatatggaaaacctagttaatttataccaaatgtatgtagaagcgtagaacatcaaaatccacaattgaaggcaacctgggaactgcctgggtgtctgtctgatcccggggggatgccgatcatgcacatgtgccagtacggagtggctgggtattatattttaccatacgaactaccggttgccttcagctatttcaatgttttttttaaattatttctattgcttctccatgccccttttctccgattctcatgcaactgtgtcattggaacattcgatcctcttcttgaatggttctatggcccctggtgccaagcttcgacgcgcctgttaagagaggcagacaggtaatagccgccctgcactccccaggtccatatcttctgcctcacttttttcatatgcatgactcgccgaactatcatcaagatctgcaagaggttgaagaagtaggtcttatttgaaacagctgacccctcggttatttgacagcctcgccaaacggtcgtaggattcaagtctacctccgtcatcgccgaacagcctccagatcatcatcccaataccatttagatgtgacagtcaccgtctcatgatttggggaagccaccgggtcaaggagcgaacccggttgcccttgcagcgctagccctagggcattgtttgctccgtcaccgctatttggctcctaacgccgaattcgaccacaccggttcttttgaccaagcttcagcatgggccatggcgttttcggccaaagagcctttgttttgatgtctgttggcccgtctaggcactgggatggaccttgtgggcttagcgatttcgctctcgcattgagcattgacggcttatgtacgaagtgaagattaccgtttttcctcttcggttcaccccagaatgaggcaactcttggtcaacaggttgtctgcgctacaacatacaacatatattgtaggcacaccatcactagccgccttgttgaatcaccagtggacagggttccttgtatgtccgatgacaggcgatcattcaacagacttgcaaatgggctgatgtacagctgctaacgggttatccacccagtagtgggccacatggctttgttagattgtcaaaatgcccaggtgatgacccgacttggacgggatccgagctatggccgggtatactgctacctaatatttcctatctctatctatgcctgagtcaagatacagtaatacatagttctaaacttaggaatagctttaagactcatatccaatacaacttactatgtggtgggcctaacacgaacgtggactttgtagggtacaattggaatactcaacatcagccacctcgtacagaatctctccaagcctggactttgaatccatcaaaactaaaacaagtggcttggcacgatgacgttagtcaatccacttcctgtcagaaatcttgggcagggctgcctaagcctatcacctaagcgcccgtaataagagtgcgttttaagaggcccagtctaaaaacaacagcgtgtactccatactcctaggatgtagtcagtttcagttctgttgaatatccaattagacacatatataatccaatataacaaaacaaccacccaattaatatgtaccacctgggtcgcaatttacaaggcaacttacgcgctccacttccccccgaacaaaggggatctagcccgttaatttcgaccttcctgggaatcaacttaaaatggagctgcaagggagcgatgatgtgatattgcaagccacacgggaggaagcaggaaagatactagtgggcgcactacttatccatcacccgggtgaaggtctgtttgttccaggggagatcccctatggagtacagattatgcgacaatgaacttggattttccgatatttacttagtgtaattagtgtaataagcttgcatggaaccatgcgttgaaatctagcgtctgaagcggggaagattggctgcagatttcgcccgggtgaaatccacacgggtgaaattctacgtgacttctagagttcagggatctaggatccttctcggttgcatggcaaaagggtgtgtgctcggctaccttggaaggtatgatgcgattggtgagtctttagtgcatctgtttggggtttacttggtcttgttttaccctcatatgatcttggaggttgcttttgctttgtttcgagaatggtggatgcgacctttggagtatgaggcaaatgcatgtaaccactgacgggttttattgaaagggctctgacatctggccgctttgttttcctaaatatgagcaattcaaggtggatgccgtattaatacctggtctattttgagattgagggactagctaagaacataaatggttctataatataaccaacggatttgtggagacactagacactgttgaccgctaatgtagtacttggctgaagtcttttcccacttgcatctctttagagcccaatggagcttgggtgacatgcatgtcctctggacccgcgatatcggtgcgcatataaggatatgaatgcccacagaaaagaaacattggtatagcagatagggttaatatggctctgcaaatataatctagtcgccatcaagacacaacgtaaatctttgtgcgttatgtaggaagtctgtgagactgtcgggccccatcgacattgagatgcagctgcagctgcaatcttggggaagtttattctgatgaccaatctactgtattgaccaataaaattcttgatttgaggaatcgttctttaaaagggataaacgcttgagattaccgtggtaggaatgtcaagttcaagtgcgactcgacgagtgccagacatatagaagatgtgatatcgaaataacagcgctgaaggcatccgggtagagttgacccctgaataccaactatgcgctagtcgttgcctctaataaaaggtggaactatattgcgaatgggctcaagaaatgaatccatcacacatttgagagagtcgtttgacaatagcagacttaattacatattcaaagggagtcctacctatatttatacaatgtctatatatgtaaaatgtgtccattcaggatgtgcatgtatgaaaaggggtaccagccttcaacgacgtcatagaagcaacattgacaacaatgaatatccacacgtacgcgctgtgtccaaaacacccacaaaccaatcccatcgtaaaacatcccaagggctgaggtcttaacccgaattaatgaactccctccgccttgccgcgcgacacctaaaactaacacagcccacccccacacgcagaccaaccatcaccatcaaagccaagacaaaagccatgtcaacgttcacagtccccaactcaaacctccacgtgaatagcatcccagacctaagccaggatgatctactctcattcccagccttcaaaatctggataacaaccctccagcaatccctcgcgcgacaagaacacccctcacacgagttccacagtgatccatatgtcctgcgcaaaatcaatatccagtccgtggaccgcttcggtggcgggcgactaggcttcgtcaagttgaaagcagaggtatcgaatggccagggcgagactttgcccggtagcgtatttctacgcggtggcagtgtcggcatgttagtgagttgtccccccccaaccactaaacttgaaccatttctactcgataagaggggctctagaagaaaaatattacgccccagccccactatcgaaaacataagcctattttgttcttttctaattctatgaatagctcatcctccaaccggatgatataccctccccgaatgaaaatgacaagcgcgctatcctgaccatccagccccgtattccagcgggctcgctgtcgttcccggagatcccggctgggatgctcgatgacagcgggacgtttgccggcggtgcggcgaaagagatacaggaagagacggggctgcgggttgagcagggcgatttaattgatatgacctcgctggcgctgcaggctgcgcaggaacctggttacggtgagcgtctgcagagtgctgtttacccgtctcctggcgggagtgatgagtttattccgttgtttttgtgtcagaaggctatgcctcgcaaggagattgaggagctacaggggaagttgacggggttgcgagagtccggggagaagattacgcttaaggttgttcctttggcggatttgtggaaggaggggcttagggatgggaagactttggctgcttgggctttgtatcaggggttgaagcaggaggggttgctttgagtgggaatagtagatttgtatcaatagaggtttgtttgtctcaattattgtcctactgcaagctagtgagatatgctacaattgctagctcacaacttccatttttttgccagttcgattccctcagccagtgttccaaccctggcatcaatagcataaccgtctttttcaagcttcttcatctcgtcaaacaacgtatccaaaggaacagtaaagcattcaataaactcattatcctcaagctcaggctttaggttcttgttctcagggagggacatatcgacacggacatggaccatatgcaggttagtattgcaaagtcctgggtctgatcaagtcacatatattcgtcagctttcagcgcccgaaaaggtcaaacaacgcaggcaaaagaaaacaaagccggcagccaccgctcacataccgttatacatcactggactagtttgctccgccacaccaacataaccagtctcctccttaagttctcgaacagcacactgctcaggcgtctcacccgcatcgatgagtcccgcaggaacctcaataacaactgcatcaattggcggccggtattgcttctggagaagcagctccgagccggtatctttgttcagaatagcgacgatcccaacgccatcgagctcgagaccagcaggacgagtctggacaacgcggttagcatcaaatccgaaatgcaaatttcaaaagcataggctctgaaaggttgcttgaactggctggtaaatgggatcgaccaatgcacccaatacggattacattgcaaggcaaccaatggtcatgtgaattcggttgatgcgtcgggcaacgcccgggtttatgccacctggagcacaggttcccgaggatggggagccccactagtgctaaccacatttcctgattcagacgaggctggagcttagtctgtcacgtaggtggccctcgtggcagtcctgcgggcgtgtcattttgatacctgcaccgggtgtcatgcatatacccccggacatcgaccaacgcgcagaatacggataagcagaaaacaaagcgggataggtcttaccgtgcgctcagctgattcccatgttcgctcgacacccagggggtcagtgtatgttgtcttcaccatgcgagcccagcgggcttcgttgggatcctgtttggtaaaacttgtcagtcatggcctagcgttgtactactggtggtatcatcccaaatctattttatacatagcagactgggacttgattgctgaggggactctcggggaaattggagtaaacataccaacggtccccgggagacgagtttcgacttggcctgcgtgcgagctgacattgtaatgggttggcagtggtttagattgaaagagtgggaacaagtggcggagattcgatggcgtatgatttatccgtccaatggagtacaagactgacgctgctagatctgcgaccaatcccaaccggagtgacctcgggaggggtgatggcgggggaagcggggttagcccttatcttatcagtctgatattgatgtcttcgatgttgatgtcttcgatgtttcttgagtgtattcgatcttaggatggaaaagattgctacgtcatacgggacatgaagtaaagactcgaactgactaataaaaaggtatagttaaatggtatctcattgcgcatcaaaacctgtctatgcaaagacggaagatactgaataaaggtgcaccaggcaaagaagaatgtagcaatgactggacacagtccaatcccaaaacaagtcttgccactcttgtgtcaaagaaatctaaaagcccttgagaacggaaagcttcaagagaaaccaagagtccatgatacatagagtggcacaaaaagcagaaaataatagaagaaagagctccataacgaccatacgctcgctatcatgacatcgtggacgtgcaagcgtcaccagcgacagtgcgtttaaaggctcgactggacatcaacggagacatcattctcgatatccttcagacgatcctcaaactcagaccaatggtacatgacagtctttgcgccaaggtcagtcagggccttcgccatcgcattctgcgtgtcttcgccattgtagctgccaacgtaggcgatgacggggataccagcacgaatcgcggaaagagcgccagacttgctgtcctcgatggcaacagtctcagcagcagacttgccgacctgttcaagagcatacaggtagatagcggggtcgggcttcgaggtgggcttcggcagagagctggcagcgctgaagaccttgtcctcgtcaaagaacttgtcctgaccgacgttcttgatggaagcgagaacgcgacgcaaagcggaagaggacacgactgccagaccgtacttcttctccgcgaaaatcttctccagctcctcggtggcaccgatacagggcttagccttagcattcaacttggcgatgactttgtcctcttccttcgtgacgtattcctccagtttctctgcatcgatctcgaagtcgtacttcttctggagggagaccatcatgccacggaagttctggccaacaaagtccttgatgagctgctcgccggtgtaacggtcggggaggttattggcctccaaaatctcattggccaggtcggcacaggcctcgaaggccagctcctctgagaggaccagagtgttgtcgcaatcgaagaagatttctgtgatctgcagtaccagttagcacctgtgggtctcgtgggagataccggcaatcctcgcaccttagtcatgatgaaagtacggagagtagatccgagatgtttgtttattaagatggggaatgcgagaaaaggtggaatctgtctagtatagtctaggagagtggttggatgcaggtcaaacgaagaggagaggaatgccgttgaggaaataggcaaccggagtatttaagtcaaggcaagtgctgaccccgaaaagcaatgacgccgcgatcacaatctccaaggggaaaccgggccaaagcgggaggggcaggtcactgacgtggggccagaagtattagatacctgagattggccctattttatcgtacaaaaacaggtatctaatacctcaaacctggggagacggccagacattcagccaataaaaaagcacagacctatagtgaactagtctgtttacagactagcgtcttcttttctactccgagcaggtgcgaatggtttcacctcgcagtttctcgtagtttctcacatttcttttctctcaccgattcccttcaatgttttccgagtttgaaacttgccttgatatacaatcccgtgatttcattcttctatgagtgctctgatcaagtgacttttaatatgcaagtaaccttctcacctgatgtctagatcgtacaggattctaggttgcaaatgggccgtttcattggacatcgctccagggctggataccactatacatcagcctactaggcccaaacccatgcacggccatgctcccgtcttttcactgtcctttcactgtcctccgaggggaggcggaactccaattcggaaaaagcagccggggtacggaatgattgagaatcatacacaagtatgcaggcgcaaagctccgcccgttggtccatttttcagtctcctctcaaataactggtgcgctcagatgatatcgagcacaggggtatgcacttggacgttcagagcatgcttggcggggactttaggagagaaccccgacattaacattacctcggtagcgagtacatatagtacttttccagttccggtgagagatgagccatttgactgctttatacctcattctattattgccgtggtcaaagggttaatctatcatcatctccgtgccagggggagttgtgcccaaccttagatgtatactttttactctcctttccggagcatgacactccggaacctggcgttggcttgctagaaccttacccattattttattatttcatcccaatagagaaagatttacacaaccaggaaccatgtagcacagcgtgttgtatatgtatacatacattgcacgaacacgggtccacctcatacaaccacgatgattggccagactcaaatcccaaagataatattccacaacggccttccctcacatttgacccgaagacccaaaaaaaaacaccgcaacataacccttcatcaaatcaaaaccaatttaatcagcacggctcaacgggtctcgggccaaatcgccattttgcacagctgaacccgaaacggcccctagtacaaccccggagtacgacctgataccaatatttgaattccaaatatacttggcaacagctctagccaaagaaggcaaacatggggtcctccgatactttcccgacactagagtcccttcatttcccgtcggcgcagctgtcaatctcccagacgctttcgtctctgcgtcaatcagcgctgtccgtcgccaaccggctccagtctattgagaccgatgccgcttttgcacaggaggtcgctgaccactatggtttacctctggtagccaatgagcgctgtggtagctggtatatcccgcctacggccaaggctggcagtgcttatttcaaaagcaccgatggtcataccggtcagtgggattttagctttcgtaggctgaacttgcagctgctcccgctagctagggagcacggggggttagtataatcccccttcttactgtcttttgcttgtggagtgaaatctgtgttagggtacctttggctggccttcattgagccagataaaaccatggcaaacccatcactgcagaatccttacaagagcccataaaaggaaacgcaaaaagctgactatattttgtttgattttgcagttgtgtaattgtggactcaactcgccgaggaaaacgtatgtacccctacctgcaccatcccaattaaagcatcatccagctccccttacccaaatggtcactatgcatgtcatgaccacggctaagcctcgaactatttattaacccgcccctagtgatgcccgacgcattatcaaaaactgtcccaatctggagcgccgtcctcaacagagccctgttcccatccgcaactgcatatcacccagtccgccttccaccggattacctaggcgcatcagaagaagcgcagatcgagaaccgaatcgaaggattcgtgcattcactaaaggtacgcatgcataacacgaatgcaacttgcacaatagttgcactgcatcccccttcctcatccagacaaaaatggctgatacctgataacaactagagtctaaaactcgatcttgataatctgcgccagcaactcggcaaaccaatcgagatcgcctgggcaaacaggacatatttccacccgcaagatctgcacaagggcgaagagtacaatcttctcgtactatgctccgcttcgaggcgcgtgcatggcgccgaaatgtccgagggcggatacatccaaggcgcgggcgatgatagcgaggcatgggcgcatggcctgacgccgccagtgttctgggccaaccaggctgttttgaagagtacacctgaagatgaattgccggagcttattgcgcggctggtggctgagcataagctgctggatgtggctcaggatgcgacgctcatttctccaacgcgcaatttgtacattggctcgggatccggggttgatgttggaggtcaatatgatcttgtcattgactgcaatgcaagtcctgcggctgcagaaggcaatgcgaagcggcttaatttgggctgtgattctgggaagctgggaagccgagatctacggaaatgtctggataaggtgcgcgactttatcggcgcccgtcttccggcggattcgtcgctgtcggtgctggttacatgcgagaatgggaaggatctttcggcagggacgcttctggcgatcgtttgtctgttttataatgacgagggtatgtatgcaatggcccaggcggtctgggtgatggattcagacgctatgtgataagaggagaaaaataactaattgttttctacaggccacttcgatgcctcactgagcaagcgtgcgatcagcaagcagttcattcgacagcgtctagcctggcttgtgtcgtcgaaacatgacgtgaacccgtctcgcgccacgcttcagtctgtcaatgctttcctgatgcagccgccggattattgacctcgagcaatgtggctacgtttcatcgcttggtaggacctgattcgtgtcgaagcgccagggtcataaataacctgccccggagatcgctcattcgttgtccacggcctccacgatagcgccggcactgccctggtcgagggaatccagcacggccatatcctccgcgctgaggtcgaagttgaagacgtccgcattggacacgattcgttcggggttgtcggtcttgggcagaggcacccagcccttctgcagcgcatagcggatcaagacctgctgagtggacttgccgtatttctttgcgacttccactagtgttgggtcattggatttatagtttcgtacgatgggcgaatacgcctcgacgataatgccgttcttctggcagtattcgttgatgacgcgctgctggcaccaagggtggagctgcaaaaatagaatgtcagtgatcacgatcagaacagagatctacctatgtagatactctagagtagaaagagaagttaaacacctacctcaatttgattaacatgaggcgggaacacttgcgcatatgagcgcatctcctcaatgtgccccacaccgaagttgctaacaccgatactcttcgtcttgccttccgcgtacagcttctcaagcgcctgccacagaagcttccgcccatgagagccagagctggaagagtgaatcaagaacaagtcgacgtgtccgtcagcgccggcaatcttgtggacggaagccagcaatttatcgtacgtagcctcgaccgaggctgcggggctgaggatcttggtcgtaacgaagatctcatctcggggaacgctggtggtgcgcagtgcctcgccgacttctgcctcgttggcgtagaactgtgccgtgtcgatgtgtcggtagcctgcgtccaatgccttcagacaagactgcacgcactggttggtgggggagcggtaaacgccgaagccgaggcgcgggatgcggacactcgagttcgggagaggaaggcgatcggtaatattgaatgaggcggacatcttgaagaaacctgggggtattgtttgcgaaaggaaaagaaactgactaggaatgccgagttcagaagaataatctcctggccccgctttgcgaaaatgacctcatcctggatgactaaactcaaacacctggggccgcggctttccaaggttccgacatcacgcttcctacgatattaccaatataggcaagtcaaattgattttattctgttggactattatgatcaaggataattaatcctctgcctacttatcatcgaaagctgaccgttgtacacactggttcctgtattgtacctagtcaccagagaattgcgtgatccgtacatggtgaatcatttgaccttctgactgggcttacaattatttttataatgctattgcgccatcgaagaacatcgcccggagatatatagtgtaatctactagagtgcttttgaggaaaccagatcaagctttggtggtcacgcttttggtcagttctaggcaccaatttgaagcaattgcatacttccacttacagtttctatactactcgtgcacattaagtatctgattcatttctttcacctcagatatctctcaatttcccttaactttacttcttaggtgactatatatagtccttctcctttgctttttaatatcttcttcctcgctatcactcgcaatcctcgggcttctacgccagccctaaggcctccctctacagaaacaagggatgccctctctatacagaaataagggatgccctctctatacagaaacaagggatagtgttgacatgcatacatacgatacatgcagggtatgcgttcgtctctgtgcagagtgagcaagtcgcgttggtcattctcgaaggcttcatatacagcctcctttccatgacttcggggaggtcgtcgctccacctgataaattgcctaccgctgtcaatccgaccacgacgctgcatattgacgccgagaactatgactggagaaggcagacgggggggtgatccacgaagccaccccaaaaaaactcctaggagacccacggttattttggaggtcgccaattcggagacttacgccaagcacaattcaaggaaattccgaccatacgttgcgttaccgacagccttgtcctcacgtactaccacggcatccttaccctaacccgcccaagcaacatagttggctttcaccccggcttgggcccgacgggttccaagttagcgaagcaacaggatgccgttccctccgacgagtggaaccgtatgaaaaatgcgtcgtacagtaaagcagtcaccattgcattcgtcgacaaagccagcgtcaagagcaccaggacggtcaccgacagacatccagtggatccagaccccaaggggacaccgtccaagaagaaaagtcaacgttgcaactcgcagtgcggcgactgggtccgtcacggagatgatgttacacctgagaattagtatgccatcccacgaaaggtctggctggtgtacaagaatgaggggatgactctgaccttgacaagggtcagagtctttccctagtcattgccggtggacacctcgcaggccccacgagacagttctgtcgccgagcgtatcgagaggccactccctgagcgagcgcaggctacttcgatcttgaggaccctttggcaaacattttcgaagacctagtttgctttcttgatttgtttgcttgttgctttgtttgcctcgcctaagcgagaagagacagggtttgcatcgtttgcactagatctcggcttgattagctttctcagatcgctcgccaggtaagtctatttggtttcattccgggtcagcatcccgcagaaatcaagtgctaatgtgtatagatgtttgctgatttctcaggatggtgatgaactgtacatcaccaaggcctacgccctcgacaagtacatagctatcgtgcgggaccgagacagaaatgctatcaccaagaacgacttcttaaaaattcgacaatggggagcctggaaaattgataaacgcgaggacgtagaggatttcgctaggctagtgctggctatagccctgcagtctagcgcggagaactagcactctaccgatcaatctttttcgcccgcttctttagtcgctttcctctatgtgggatcccatcattggggattatgtagaggaggagtccatccaagcatctcatctgtttccctatatgaacggccaagatacgatggatgcgatattcgggaaaaagaggtcagaagaacttttctccccccggaacgggctccttctgcatacaaggctggagcgctattgggatgctgggaagttcgtaatcgtccctgatattccgagttttcagggcaacgccctggtatccgcggtcaagtactggctcgagtgtgagccccgggagtaccgtgttaggctgatcgacccggattgggagaaacttgacgagtccgtctctagacagacgagtctgacattcagacagctagaaggccgtccactgaagttccgttcaggcttccgaccagccgctagatatctgtacttccattactgtgtgcaggtactacggatgtgctggcaacatagcaaccgcggcaagtcaagccaagccgctgcacttctacaagcagaaaagggcaggccattctgggggactgcgggaagatatctcccacacaatatgctcttggccctcgtagaggagatgggccatgaatattcattcgtcatgaacggggctgctggaagtcgggccaatgacgataaacttctactagccttactttcgaaaaacgtcaaggcccggccatctattttggccccggggattttcgataatgcttgttcttcggaggaagacgtgtctggggttgatgacgatgacgacgatgacaacgaggatgagttgggtgagtagggtcgcttcattcaagaatagccggggatacatgtatgtattattaccacccgtaccagaattgattgggaattaccatgttgcatgtacgttgtatattctttccgggttggtagtcactagtaacctgatttaaatcgatataatcgacaatccatcatcgacaacgaccaggaagccacccgaagccttggatccaaccaccagcagtcctgatctcgaactagctcggtgtcgagctcgtatgctctcgagcactacgacgaccaaacggaaagggaaagccggctagcccggcctaaatcccagtgtatatgcagtagtatgtaccggattttaggccatcacgattttcccgatcggggtgcctttataaggcttaattgagtattttatagtatagcggtcctacgctacactgcccccatacctttctaaggggcaaagtgaaagaattcgtctttgacgtgcctctgccctgcacgaagccatccgctttctcttcggccgactgtctgctgctctatctaccttaactgttcttgttctttactgcatacttcataccatttgctgatgagaactgtgcattattggggcattctgagagcagaatgtagaaatccagatgcattagatatatcatttagtacaaaacatatgatcaatgagaacaaggtccaggtatgccaacatacaaccccaaagcatctttacaatgtcatctagaacagaactttgcgagaagcattgataccactcaaattccatctttctggggcagtccgctccatccatatcgaccaatctccccagaacgcgggcctcatgatctgcgcatactcccaataatccggataccagcctgcatactcccagtcgataagccctgtgatgttaccattctcatcaatcatgacgtttcgaggtgcgatatccccatgcgcgaacacagcatggtcagatttgggcagcatgttgggtaattcgtgttcgtaccgactacccccgcaatggagataacgctcatagatgcgagcccgtaggtccgaatcgctggttaggggtcggagtggtgattgtagatcctctagtaagggatcttttgatggggagccgtctgccgcgcattgaaatataccctcgtattgagatgggacggaccggatttcggagatgagatcccaggtctgacgacaaatagattctttgttttttccgtccatcgtatcccatgtcccttctaatggagatccctggacaagggacatctcaataaacccattgtactcggagctgaaattcgtatggtacacttttggtacaggcacggtggtatatctagagataagtctcatagcttcagcctcagcgggccgtaccccatgcccggatttagtcacaagcgaaaaatcatattcaagtataatcctgcccattggtttgccgagcacagtaacgacctcttcgtcaggggccaggtcgaagaaattgaaggcgttcacggaggatggacatgggaataatgtttggcctcttttgatatatcggtttccttcttgaagattttgtgtccgaaaagggcgccttcggagatgtcaatcatcttggcggcagatgcgtagttctcatggtgctatcgatgtcaattggtgatgtgacctgtgttcacattggtgggcacccagctgaggggtctagaaaaaagttgtcggggacaggtagaaaaaaagcttactaattcctagccctgacatacgggctgcttatttctatctttaaatcctcttggttagttattaaatgtaaaaggaaacacagatgtgaatgcaagcgacgagattcgggcacacttgctttgtaatagttattatacccgtggacctacgtaaaatcactatctagctataaggtagttaggactgcgttacactcaagcggatgtcatgtagatgcctgaatatcctcgcgactttgtcgggttgcgagagatcaactagagaccactttgcgcctcgcataatcttcaacaatacccatagacccacgaagacaataatctggttcaacagatcttagttagccaatgcaaactagactcatcacaatattgcccttaccgtcaggtacgatgctaggaatggtaaaagatggaacccattccacaatgcagcaccgtttgcgaccaatgagacaaaaacacagcctaaaaaggctagatatgccgtcaatggctgcctgtggctgcggtacggatagtcatcatggccatcgctccagcgctgaacgtgggcgacatgttcgcgtcggagataatcgcgatgccgagaaatactaggaggaagagttctagttaatattcggaagatccagcatctgaatgactagacacaccaatggtagaaccgaatgaatgccagacactcacacgcccagacgattaaaaccgcagagtatgccatttggctcaatacctccacgaactattcacgtttattagctctgaactcgaaattagagggaaaatccacgtcacatccttaccatatccacggacgctcgagttcccttcaaggaggagtcagtggtagcagaggattgagtactcccgcggatcagctgcaggaatggcacccaccagaacgccaccgcggagaatatcatagctcgcaggggaacctttcgtctatctgttttgccaaaccatgcgaatacacgcagataccacctctggccttcgcctccatccaaacgacttgttaagccaaacaaagcccgagaggcgacgtacagattggtaccagcacaagagaggcacgtgaacaccaggaaagcattgaacacgtctgccaagtgcggaatattggacattgtggctattgcgacgaatgcagcactatttgaaggctttgtgcacccggcttccacatccactgaaagccaactgagccgagggagagcgcaactcttccgctctatatccaatgtcgcgagcagcccgctgatggtataggcaaccattgcaagtacagggataaatatagcggaaaacttgaatgatcttctgacctggacgtcattagaccgtgaaagtttgtctgagattggcgacatttcgtctgcgcgatgtagccaccgtgcctctagggcagaggcagcaacaacttccactccggtgtatgcaaaagttgctattgaaatgctcatccttgtatattaattagcaatttgagcacagataaagacgcatgctgcgactcacagtaaagcggtgccccagttattggccgcccgtgtatcaaatgcggtaggcgaagtccagtctgatgatatcagtattccaatctggcgaaaaatgtatgagacggtagcaattgctcacacttggcaccgatggggagagtattgtttgggccagctgctcatcgtcagcacatattccccgaagaacagacacacacagtccaaaccatccgttagccactttactaacctccaagattgattgcaatcagcgtcactatgattataacaagaaatattattttcagctggcggcttcctagtcccgaagtcgcgagtattcgcattgatcagcaatgacggatgaagcatacctcgattcttatggcattgatacagacgagtatcagtgggatcagtaggtatataatcaagccctgtatagccggtctttcgtggatgtaatcccaaaaattgaactctgcagcggaggttgccaccagtgtggaaaatgacatcgagtaaacaaaccttttatagttgtcagcagctcttccctagtcctggagtctaccaaccctttccatgaaatttgctgagaatgcaacttaccagtacgtcactccgaccgcaatccccagttcttcgtcgacgaactggctaacatatactgacaatgcaccgggtattggccaaatgcacagcatttcagtgatacattgcatgacaccccatgttaggattccgatgaagaggaaagatagaaccacagccaacggtccaccgagttcaagaatctgaccaccacgccagtagaggcctgtaccgagagttgcattgactgtgatcatctattcctgttagcttttcttatttccaagtacaacagattggccaatgttgtctattgaaggctacaatgcagaaaggccccctctcaagttcggaatttcggaaaatctgcacatacaaatatgtggacacctttcaacgctctgctgacagtccgttcccggctaagtccgacaacaagccgttcctctgggcatttggtgagaatgccagtgtcttctgagtcagttgaaacagatgacggtgcgcttatcaggctcggagagtgatttggcggacggagaaaagaattctgggatcgcggatgtggacttccacttgggatttgttccatccttgtgggcaaaacaccagagagccagggtcgtgcccatgctggtagctctaccaactgtgcctctgccggttgcgacatgatgcaacaaagcgtataggtctcctatcaatattgcaggattaccacacgatgcatgttcaaaaggtaggggtaatttctccaataaaggtataacactaagccgcattttgagcataatgcaattagccctcctggccgaactacagatattgaaagcttcgccccctttggttgcctccaagccctagaattacatccaagcagtatgcacccgggtgaccaaaacaaagcggaagcgatatcctcatgtggtatagtcgcgcataatctcaagaaaactatcgaatcagcgatacctgatagaccgcgcaaaattgcaaaggataagcaaggcaaagatcggctttgtgacgtgtcagtgaaatttgcccgggtttcagccgcagcttggggtttatcatgcccccgtgtttgggaggaactgtaattcgtaaaagcaaagtcgcgattattttgaaataaccatgcctgggaatacagaagaacaacaggctcctatgcaaaccacgagtagccgctacttgcggagagacagtcttcaggatctgcttgaacgactgttccctggacaaacagacttcggtattcaggtaaattgcctgaaactcgcgcatcgggcgcaaggctgactctaagattctagcttctagaagaccagtggatcttcactgcccctaagatagtggagactgtaagttacgatatcttgcctctcccgaaatgaagtccgatgctgacacctcttcacaaggctgatctcgagtaagagttcttcagtttttgttccgaataagtaaactgacatggaattagttcggcgcaggatgtttagcctaaggctggtgtgataggaacacgagacacctcgagtagaggcgaagcacatgaggcatatcaggggcatcgggaatagggtgtgtggcggagttcgctcaatggacatgcctaggtaccccgggctcgtagatctgatataataattcagatcctaaattcaatgaatctaatctcatcattctctctaaaaactgcacataatgacttcctttgatcattactgcctagaccacctggttgaacctgtacaagtctttgagatcggagaggatgcgacatcgttcctcccaagaggctcataccaacgatcggaccttctcacggtagatgatacggtatcctttctgaaaaacaatcagaagccttacaaatgtcgagtagtgtatgtttaaatcggacatcactctttcttctgctaataattggtaggtcaatatgtcaacgtacctcccggcaaccactgcaaatcactaaacccatgcttgacctcctcgtcgctggacacgagataggtccatcattttgggcggtgccatcatgtttttatcggcgcagtgatgacctcgaaggggtgttttgccttccatttacagagtcctgctctggctccataaatggtactttcaacccggtggatattgacactgttgctaaatttaagaaacagaaatatcttacaccgtgagataccccgagtacaagccacaggaggacaaatgggtcattcgccagacaggaatttaccaccgatacgacaaaacttcatcccaaagtcttttcgtattgttcaaacctacgccacaatcgaaagcgcattcgcaggctgagagtttactacgcaatctctgccctgaggtggagtccgatctcttttggctacaccgggtcttgttcgcaacatatttcccgacatggaggaaatacatcgccgtacaagaacaacgatttctgcctctgggacggagtgcaatcgccacttttattagtggacctttaggtctaggccacgatagccttataacattgacagccttgcagactcgatttctcgaagtcccggccatcttggcatcagcgacaggcattctcgacgagctgtgtaccgttattagctcccagtcagtgatctcgaaaaattacggaattcactcgtttcaaaatcatcgtggagagtgcattgcaaattcccacaatgcttcacatttacagcagcgggcacaggttatttcaaagctactagccgacactttattgtttcgggatcaggtcatggcaaaggaacaaaatacgaacatgctacagctgaacaagtcggcagtgtttataacccttttgacgttgttatatcttccttcatcattcgtgggcgttagtacccctctgatttccaatacacctttgtcaggccgcgactgacattctcacgacagactatattcggtatgaatttcttcgacctggatcaagccaacaatcgtatcgtcggtacacctatgatatggatattctttgcctcgtccattgccctgacagcaggcacgttccttctatactactggttattgcgccgcgacggtgaaacccttcgcggcattgctccgagtagtcaaacctggagtatcggagggttaaggaggcggttcacagctggctccaatgccagtattgagctgcagtcttgtccagcctgagaaccaagcttcgataagaaaaatactgtcagttatgtcaaagttctatgggttttgggtagtaaaaccgcagctagacatgagctcgagataataggcaaaaacggagaaaataacattatgttatgggaacagtattgtaataccaaaacaagatataaatgattatcaacaatagcaacctatgctgcagctgaggtacccgatctggaactaggcacagtgattttgtatattccacattgattcgcacccatcaaagcagcaagaataacgacactctcgctttcaccatggacgactctctctgcaaaatcatcgctgtatgccagacccggaatttcagcaagctctgtcacagaaatctttgtttcctgaggcagtggcatgtcaacctctaataaaagcatcttatgatgggccgcgcgccttcccacggcgaatattttctcatcatctttgcccatcattagcttcagcactcggtagttcttgatatcggcctgtatagcagctgtcttatccagttgtgcaaggctttggatgtgcaactgtttttctcgggtgacaagtacacaaacatggggcttttgggaaagtggagcgaaagtggtaaaaagaccaacagtgctactactctcaaagccctgcataggagagattagacggacaattgacgttgaacatagcggaagactcacttgtggttcgataatgagcggacatagctggttagttcgaagggacacatgaatgacgggaatttcgtgcttgcgatttggaccacttcgctgtggtcggaaaaccatgtggaggtcttcgtctgttgagaatgataactgaaccacgtctgctgccggccagtccagtttatttccaagctgccagtcgtatggagaatggatggaaccaatgtataaggagccgggattttggtcctcgtctttgtcgctgacaacacatgccagtctctgacctccaggcgcgagagcaacttttttaatctccggcagtgttggtagggagattcgatccccatgtctaagattgacgtccatacctactaacccccttcgtagtttgaagatataacacttccaaatctcattagatgggaatgggaaaaataaaagtggtaaaagagaacgaaaaacttacttggaaagttcctccggaggtagaagctatgagatgttttctggtcagactgatactcttccagcgacattctcgtatggggatcggatattctgcagccgggcgtacgatatcaacctcctcttgctccagagattgggaagtgtaaagcgaaattttggtgtccgtccaaaaggcgataacagtcccgtctggagagatctcgcagcctttgaatggctctggttcacgtagataccaacgctcgacgcttctgtctgtcgcgggctttttacctatgagcacatcgatgcgcttcctccggagcctgctgcctagaccagactcttcctctggcaaagataggcccccttcattttccagctccttgtactttcgatgtgtgtcgagcaacttttcctccaattggtcggctttgcatctcttcaattgatcaggctgaagaacctcgcgctctagataatccagcatcgatctcaaagcttctccttctttggaactcctctttctagctttctttatcagtttttcatgccattctgtgacctctgggtggatccttggtcgactaaatagcgagtttgtgacaaagaagcgatcaccatctgaggcgcgatgctttcttctcctttcccgatacctttccacgccagagctgccctcctccaaatacgcaaaaacaatactgaggacacatcccaaagaccagatatcgttcgctgttctcatagctcgatgtggtgaaagggactcgggcccaagataagtgccaccatctccgcgtctgttgtaggttgccgaggccgagacatccctaggctgttggaagcggacaaaccagctgtcgaagtctgtttcctcccggcgagatttcaatttgaggcgagacatgccgaagtcactgattttccagacgaatccctgcttgtctcccacgttttcgaggaagaccaaaatgttgctcggcttcaggtccatatggtaacagactatccggtccccttcggcagtcctcatgccattatgaaggaactccagcccacgcgcgagacctcgagcgcaatggattatgtccgccttctccgccgtcgtatacggtctggttcggttgtcctccttcatatgcgcgctcagatcgcatatggcgagaggcatgaagatgctgtaattcgtgccgatggaaaggctgccgtaaatatccacgatattcggacacgtccgatcgcaggcaaggattttcttcaagatgccttgttccatatcctcggtggattggtaatctttgcgtgccatttccttcggctgctgatttgttcctctgatgtctgagtcgtaaaagtggcccttggcaatcttcacttggtatacagtgccgtacgctcctttcccacgaactttctgctccaggtagggtagacattgccggtccaggctgggaattcggacttcctttttgttgcagatcacaataggacaaaaacatgcttgttgggtcataaatttatccggcgtgacctgttccccgaaaatctccgtgagcgtcttacgctctgctggtagagcgtaaagatctggcgaagtcgtctgagccaatagtttgatggtgaatgtccgagcagcctcgatagtgcaggatgtgaaaatgagaatcgctagaaagtcataaagcttccgttgtcgcattttgagcaaactgtcttcaaggtcaaaattggatatgtccaactgaagactgcgaaaaaatcgtcgcaaaacttctggctgaagtactttcctcgcggtgccgtgaggagcaaatcggcccccctcttcatggcccctttccatcctttccatgatttgcacatagatctcctcacatagctcattgtattgagtggatgccatggagtttgctctttagtcttcggcacgtcacacaaattgtaggaagcatttacaagtaggcagaggtgacaatctctgatctcctgaccttttgcccgggcgttcagaaagataaggcaaaaaagcaaaaataggcaaaataggcccatttaatctggaataatacacagtttattcatttatacataccaagaaaggggctataatgaagtacaggatattaagacacaggtcggaactcaggactcttttgctcgcagtttgggcgaagatctgtggaactggctctttttcctctgcccatttcaacccggacatcatctggtaggtctttcgtttgatgaggcactaatctggtcctctacaagttcatcctccaaaaacgcaaaccgagaaaatgtgttgttttgtgtgcttagcgactgcttctgcttctaatgtgattcagtgaatagctgtaatatccagtcttcattcattttcatcatgtcaaacttctatagtgcgttttgaaggcaaaataaatggatgttgactgataaattgaataaacacggccaccaaagggtcgcgggcgtactggtctcacggtccgtcatggctagatcggattaatacagacaactttgaattgggggggcggtggtggggagggatctgactatgaagcgttctcaaatgcgacctttcggccctttgaggagaggggcaattcccctcagatgtaataatttgcctcatcgctcttcgggttaaagaacatagaaacgtcatagggaaatacaggaggaattgcaaagaatccatccatagtattcgtagaactaaacccttccagcccaaactcattaaacatatcccacgaggtaggagtgacgtctgtatcgataggcaacgatgagacctgtggatccaatgccgtgttattgggagcgcaagtctcgacagtcggagtatcagggcgctgaaaccatagcttgtgaagaagccttgcatagcgggaggctatgtggttttggtcatcggaaatggctgtgagaagcgaaatgaagcgcttcattagggcttttgtttcggagtacctgtttggggagatggctcctgatgcatgggctttgaataggaataccgaggagtgaatttcgtatctatttggattagtttcattcgtcgagtcaagtatggtttaatcaggttagaacttgcaggtagaagcgagttggcatgtagcgtaaatgcttctcgggatcgaagtcttcggcaaatgttttcaacagcgattctgcggcattaagtgcttcgtggatatgtcgcgcatcagcactagccattgtcgagttgggaaagtccagacttggtccaccgacatcacttttctctggggaggcgcgggaagcacgataaataacggcttggaatgcaaaggcgttgacatagagtctaagataatccttcatcaatgtcaaaaagcttttcaaatgcttggataccgcaagtgattgccatgcatgctcccacgcagtcattgctcgaccagtatcgtcgatatacttgacatagtctccacgggtgatgagcttcaccgtatgcgatttcgatgcaaaaagaatatcgtgcgcgtttccgaatagtgtcgttagctcaacttgtgcttggatccacgatgcaagatcttcatcgttggcatgattcggttggagagagggaaagtcttgtgctgtgaatcttctcgagagaccggggccacggcaccagaaagcttgacccattcgaatcgatatctggcgatctgagaggtaggtgactaccaatgtcaatacttctgtcttcttattccaatgaaacacttacaggtccacgctagacgcttccgctgcgacgcagggtcgagctcttggttcttttcttcgaacccgctatcttctaatcgtagccgatatgccagtctcacagccacgcctaggattgaccatgcagcctcaccaccatcgtcggtctgtgtctggccatagttgatcagattccattctccaagaagtaaaagcccttcgacacagccaatatggcggctggtagctaccccgagaacaatgtctaaaatctgtcggcggagataatcccaggtggctttgtagagatctgtgagatcagagcagtcctggagcgcaatgaccaagattgcagtgatcaggaaagactcttttgttgcaatctgttcaaggcgggctgggtcaagcacttctgggggtactattgggaagaatggatggtagtttctcctgaatctaaccgagatgagttattgtttcaagtgccctcggattacccgatgcgttgacttacagacgtagaaggtccagcaacagcggcaaagtaattatcttattccgcagtagatagtatgagcccttttcatggtccgccagataagtggtcgtaatagatgaggtgttacgacaactgccaatattatcatgttgcacttgtccgcccgttccccctggggcagcaccactagcatggctatatcgagacactcgagcgtcatcgtcgataatacgttcttcttgtatatccggctggccagctgagtgagccagaatcagtaaggcatccgatgggttctgtagattgtcgtgtgttggcgtctctgcatttgtgggttgcaaggcctcattatccgaaggcgaagccgataggcctgttagggaagaatggacgttctccgaacattgctgactcggtccttcgtttgctttctgcgaagctgattccttccgtgaccggcggtatcgagagaagtcaccaccacggcgagaacccgccaggacacatacggcgccctcacgggagcatttgacgcacggaggtatccccggttctccagtgctttgcctatagggaccagactgttaatccgcaattttgactggctagccggttgaaggggaaattcttttcttcatggggctaaggatacgtacagatcacatcgcgtttttcgggagcgacacctcacacaggcccgatattgtcgaaggttctggcccttggtcatttctcatcatcttaccccggtccgtgtcaactgtgcaggccaacttcctttcgtgcaacctaattgatgcgaaattcgtttgagaagttgggggtgcccaaggctttagacggctacagatatactcttccccgcattcgggatgtatgccaatgcggggccgggtctagacggttatagatggctacagatagggccatttcgaatcttagatgtctatagcttgggttacggcatcaatggtgacgctcattggtatcctgaaggctcaagtgtcgcattggtgtctccagagcccggccttcctccggcgtaagctgtggggtggcttcatgagccagatatatagccttgtttatatcatcataccatagcgctccgctttccatctcttggaaagcatattatttctaggatttcggattgcctgagctcaggcttttgttagaaacctcatttccacggccattaccatggctcccagtcgtgttgaaccaccccagcatgccccaacagtccggacggcagaaagcccacggtctaccagtaccttgaaacctgcagtcaatgaccagtatggggcatactatccagccgacccggaaacactcaaccttgagtccaatttcggacccatggaccctggcagtgtcggataccttcagccgacttcagtcgatacaccactagaaattatgcatgaacgatttgagcgggatggatatctctttgtatgtcaattatctcacgctacctgggtatcagtataatatgagctaatccagtttggtaactaggtaaagggatgtatacccagagaagcctccctgaaatgccgtgaagcgtacttcgaatatatggcaaaaagtggtctgctgaagaaaggaactttgcctgttgacggtatcttttccgaaaaagacagccgaaagtatctgccgccagggaatctccgccgtcttttcggactgaaagacgacgcagagagcgagaagtatctcgaactcatgatctcggcccattcagcacctttctacctggacttttgcgcgaacgaagaacttaaaaagttcatcagcaggttcaacggctggaagaatccacaaatgcttcaacgaaccatgctccgtgctttcgttcccaatagcgagttgacccctgttcacttcgaccagatgtatctacgtgctggtcctcctacaagtatcactgcgtgggtacccatcggggatgtgtctctcgagggtggtggcctgatgtaccttgagggatccactgatatcggtcagaagtgtgaagcagagttttcgagaaacgcacacaatctgtcagatgaggagcgcgttagtgcttttaacaagaacatgagtgatggtggcttcttgagccgctatacagtggcgtatggaaaggaagtgcgtcgaaaatggctcattgctgagtacgaggctggagacgttatcttccataatccgtggatggtgcatgctagttgcaagaataaggatcctaatggtaagattcggctggcaaccgatttacgatttgttgatcctgagaaaccttatgatcacgtatgttgcccttccctgattgagtattatctgactgtacgctggctaatttctacaagcgatggatgaaggtgtggcggcctctcgacggcctttaatggtcgcattacacaccaaatggttaaacgtcactgttgagcatgttttacagatcatatccatctgcccaaacccatattggaccagaacttttgacctccagacacctatcatgttccagtattagtttatcgaagaactcgaatacagattgtgttctgttgttttcatatctaccctcccatgactatgcatatatctctagaacttccgtaaaaccgtaacgataacgatcggataactacgttcgtatttaggtagataataggatatcgttatagtttaggagtgtcttagacgtatctccgccctttaaatcgagctagtagagatattactattataaggagtagtgagctagggcgggttataacttataactagaaaaggaaactactaagatctagggtaggttaactatacgcctatatagggagataatagaggttattagataagattaaggatctatatcgatctatagtagcttagatatataagcctctaatatttaagtaacggcgtaactataagccttagcgcgctaagggctaagataataataaaataatactttatagtatatattatataagcgattcgatatttaagtatataggagataagccttagttcctaggttacttactaacttatatctaactagaaactaattatagacgataattaccctctctcttatagtctaactcctttctttcgtaatattctatttagattctaagtttcgcttatataacttagaaagcgcccggctaaattataggggtcgggctaagccgcgtaaggggtagagatagaggctctttctacctagagatattactactaatatataagttagcttaaaaagcgcttaagctattctagttatattcttaatattcgaattttttctatttttatatttcttatagaatgattaacgttagcttttatcgaatatagtttattatagaagctaaataacgtaagggctaggaatataggatataaggataagtaccttagagttagcgatattatctttaatacgagaagggtctataatcacctaagcggaattgacttttatagaagagaatggtcgatcaggcttctagcggatatgactcgagacttaataggggaagagagagaatcctttataaaaagcataggaaatgtatactataaagaaggataatataaaatccctatacggagtatatagttatatgcttcttcttcgtatcctcttaatatagtaggatagaaaggaactagtaggaatcaataataaggagcaaaaaccaactaagtatagtctggattgaaacgtcgagatgccgatatagtgtagtccatttatatactaaagatagtacggagtaagtattatcaaactgcattcagctgaggacactagccttcctttagcagtaggagccaaaatgtcaggttctgcatactatagatctgcatctgggccctttaattagggttagcgtcaatgagaatcaaattgggatttccgacagaaaagagttgatggctatatagagcggacacgtagtgcatcatccaggcgtaactaacaaaacatgcaggatatatccggacaaggtcttagagctattacaatatacgcgaactatttttactgggtttgaaggcaaactaaagaacgcattccctcatgaattccgcatccagattcctatatcgagcagatggtagataaatccccctcgcaagtgcttttgcatgatatatccaaccgccccttcttcatcaagtctggccttccattgatcccagtctgcttcatcatcatagtattcgcgaaaaatgcacaacgcaaaaatgaaaaccttgaaatcattctccgtattcctcataataaaattcctcgatcacaaatgagattgataattcgaatggtgtcttcacagatactctgccaggattctcttagggcgtgtatagcaacctcggtcaagggaaaccttctaacgtactataaaatggtactagggatgtcgacatattcttcactaaccgacgttgtctgcgaggtagaattgggcattgtaaggcatgcgaacagttggggtgtgtgatccccttatatatgtatgtatcctctagggtgtcgtacacttcaacttcggtcccgtagagatctgagatgtaatcatgaaaatacgcttcattttgggaatcgttccatgtgtccgatatccttaacatgctttttcgttgtcgtcggtctcggcgattaactttgacgcaccaccatcgagaacgaactgatgatattccttgtcgatatctggtgtctagggatataattttttggtcttttctgagttctgttgcgaaacatccgtatcaccctccgccgaagaagggcatgctagtcgaacaaccattacagacgaaagggtgaatggtccaaagacatgcatgattttggcggtccgttgtttgtttatatggtgtctccagctgcaatttcattgtattccctgaccgatctatataatcagtccgtctctacctatgtgcataggtaaaaaggtgggggtactcccttaatcccttgctccatcgtgattaggagtatctggacttgagctcataaaaatattgaatatagaaccctggaatatgagatagaagatagacacgatatattgagtacatattaatgcccaacggcgccagaatgcgaatttgaaactcggcgcaaagagaagaccaatgtatttgcacagggaagattgaaggagtcctagtcgtatcaatataaaagaaactccctaaaagacaaagggaaagggggtttgtaaacaatggctatacttagaagtgggtccacaagggatgcatctgcagtaattttcctaaactgccagtcttaaaaagtcttaactatccttttttcgtctttcattttgattcaagtgctgattctcttcgtttctcttcgagttcgaacaagaaacaccggttgctcgggtgatcttcagctccgacttgcgggacaaacatacccccactcgacattatttcccctccccctcccctttgtgctccattgtctgatctccagtccgaatcggaaagtctttaagcttctccgatcatcctagcccttttctttttcaaaccccatcccctgttcgctgtcatcccccgacattgccaatcggccctgaatgtctccgccgtgatcgaagatgttgacggttgagaagcagtggattaatgtgcagcaaaagaccttcaccaaatggtatattccctgtcaacttctctcttcgtggacctcatgaacctcagctgacgagtaacgttaggctgaatgacaagctgaaggcacggagcctgtccatcgacgacttggtcactgacctctccgacggcgtatgtcccaccttatgccccgctcaataacttcaagttgctgatcgcatattaggtcattctcattcacctccttgaaatccttggaggagagtccctcggtcgatatgcctcgaaacccaaattgcgcgtacaacgcttcgaaaatgtgaacaaaagtcttgactttatcaaggggagaaggatccagatgacgaatattggagcagaggatatcgttgatggtaatcaaaagatcatcctaggtttgatctggaccctgattttgcgatttaccatcagtgacatcaacgaggagggcatgactgcaaaggaaggattgctactctggtgtcaacgaaagacggcatgctacgatgatgtagaggtccgagacttctcctctagctggaacaacggcttggccttctgtgccctcctcgacatccatcgaccggacctgatcgactacgactcgttagataagagtgatcatcgtggaaatatgaagctggccttcgagatcgcgtccaacgaaatcggtatcccggacctgcttgacgtggacgatgtatgcgatgtacctagacccgacgaacgctccctcatgacctacatcgcctactggttccacgctttctcgcaattggagagggtcgagaatgccgggcgacgagtggagaaatttgtcaacaacatgcacggcgcatgggatatgcagaactcatatgagcgccgagtaaaggaactgttgcgactgattcgcggccagcgcgagcactggaagaactcctcattcgagggaacatacaaagacgccaaagaacaattgtaccagttctcgctttacaagcggaacgagaaacgtcagtgggtggccgagaaatctgatctagctgctttgctaggcaatatcaaaaccaagttaggtacatatcgactgcgtccttacgacccaccgcaggaactgagtcccgagaactgcgacaaagagtgggagatccttacccgggaggagcatgaacgcagtcaactcataaacgaaacaatccgcgacatcaagaacaaactgcggcgctcctttgctgacaaggcaaatgactttgcactgaccctgaagaccctgtcattggcgatctccggactggatggcgatgttgaggaccagcttgatcatgttcaaaagttaaatggcaacttgccgccacttgacgcctttctcgacactatcgcagaattggaccaacagtgtgcggaggccaatattgaagaaaacgacttcaccacatacaccttggacgagcttgcgtatgagctgagtctcgtcaaatccagcatttcaaagaagctggctttccttgacaaccaaatggttgctcgcaacatgaccaatctgacccctatccaattggaagagtttgaatcggtattccgtcatttcgatcgcgactcttctaacacgctccaggagctcgagttttccgcagcgctggccagtctgggactggtctacgacgaggacgagatgcaccaggtctacgtggaggtttgcggggtgaaccgactgtcacagaatgctggagttagcttcgaacagtttattcgctttatggtcagcgtgacagaggatcaaaatactgccgaacaggtcttccaaagtttcaaggaagttgccgatggcaaggtatgtgaagcgtttctttaacctctcaggaatttaccgggctacagccactgacttttccctgcagccctatgttacagaactggacctccgacactcgctcattccagacgatgtcattgagcatttagttaagacgatgcccacacacgacggtcccgatttactcgaggatcgggacttggccaagtacgactacattagtttcatggagaagatgcgagaagtaaacaaaaataatgggagtgagcaataaaaggtaccattgaggttgatatccgcagcattactggtggttatgggggatttgcactgacttggtgttgctgtgtttctggtgttttcagggagaatcctcatgaccttttttttcttttcgaaacccggattctcccttttctttttctttttctggtccatcttgcatcctggggttcggtggttgtctctcttaccacatgtatttattgtgttggtgtatgcttctctgtttgtaatgatcaggataccatgtgaacattttcaactatcgagactatcgacagacgtggagttggacttgggcaagcgaggatagccacggcatatgaatatgcataaaataacaatttccttgttactacaacggaatcctttgaagctattttgggcctggtcggatagatgtggatactgccgatcactaccgcattcatactgtgtcatgtgacaggcggtccccagatccatcggagctgatgaggatgatcctgcgattcattgtattccttgacacatcacacttatttcgatctttttcatttaaacactggtcataatcggatttgttgaccgcactctctctttcacatatattacttcttccctcaatcccatcccccaaccatacactccaagatggaccgcagcttggacgagatcatcgccgaagacacggtaaggctccagcaagcaagaaaaccactagagcgcacaattaactcagtcaattgcagcggaaccctagtcgcccctcaggcggtgatggtcctcgtcgtcacaacaaccccggccgtcgccacgagcgcgatggcgtcagaaaggtacaacttgacttgaaatcgaggctttgttctggagttatatttgtatggcagtgaaactaatatcttactcactatttaggtccgccctccttttcctctgcgaattctcttcttgctccgtgacaatcgtagccagtcctctggatcgttggactcgtcaacgaacacgccacggcaaagacagggaacagaactttgcacgatatcccatctgacttggagctaacgctaagtcttttcgataacaacagccatacacttcagaccgtgtcgatctcaacctgtgattacacctccctagctactgcgatgtggatgatactgaccggtctctcgttctagtgactgggtgcacgacaaatttgacgacgaccgatgtatgtggattacccgtactttgtccacatctctctaacaccattgctcttcagcccgcccatcccgtggaggccgcagaggccgcggcggatatgattccgaacggtatggatcctcccattaaaccagccttggcttgatagcttgtctggtcaaagcgctaattgaatgattagctctagcacactgaccaaggttcgcgtcgataatcttcactacgacatcaccgaaaccgatctcgaggtacgttttcaatcaccccatcaacccccatacaaaaacacccctaacaagctgcttcgctgaacaggatctcttcggccgaattggacctgtttctgagcttactgtctcttacgaccgcgctggacgctctgagggagttgcttttgttacatacgcccgcctgaaggatgcacacacctccattcaggagtatgacggagccaacgccaagggccagcctatccggctttctctcgtcgggggccgccgtgaccgtaaccccctagactctgcacagcgccctaggtccagcctcttggaccgcattcagcgcccccgtgacgaccgcagcatgagccccgaggacaacgcagatggccgacgccgtcgtggcggtggccgtcctcatcgcagcgacgtcaccaagcccgccccagacaacatcgaccgttatgtgcccggacaacgctcccaccagcgctcccctaaccgccgcggcggtggcaggcgtggacgcgacaaccgctcgcaacaaactgatggatccaaccgccgatccaatgcccgtccgcgcaagacccaagaggagttggaccaggagatggaagattactggggtggtgcgaacaacggtggtgaagcgactgcgcccgctcaggatgtcccccagcagactgctccggcccccagcgcacccgctgccgatgatgatatcgatatgattgagtaaatacttttcggccactcgaactacgggaaaatcgcttgtcttgagcatttcagatctttcgggcttcgatcgcattacttcttgggattttctatgaattaagacgacctcggcctttttccactttctcttcttttccatcgctgagcctttcggcacgagagctgaaactctgtactttacctcaacaaccaaattgtaactcggtctatatcacacattcggattttttctgcttcgattcttctttacccttgatggactcttatccttgcaagtccttccatgtccacaccggcgaactgggagcccatgagaaagggttttttttttattgcattgttcggtgtcttccttcatgtctttctatcgtctaatcgggggtaaaagcctatgcgcatatgccataaagcctgtatacagagaagaagaggctgcttgcaaccattaaatgagggcaaatacaagttgatagagcataaacccaatcaaagccgccgccaattataaatagaacaaggatcgcaatgatggaagaagatatgatatctttcgtgatttattctgtacaatgtaacaattatgggagtacaagttcacctccacaatccgtagggctcgcggcacgctttccacaacttgatagtaccatcctcgctaccagtcccgtagagcttaccatcgggggagaagctgacagaccagatagggccatggtgacccttttgaacctctgcagaagaaagttagcttaactccatgtcaaaagaaacagacaacagccgaggtaacaaaacatacccaactcctcatccgtgttcaagtcataaactcttgcccaggtatcattcgcactaccggtaaccaaacgagcagactcgctattaaccgcagcactagcaacatcatagtcataatcaaccttcttaagcaaccgaccaggctgcacgccatcaaagaggtaaacgctcttcccggccgcgacagtcaaaatccccgcatcattaggtctcgtcgcgagactattcaactcgcaagagccaatcgtgccatcaaccccatactcaacgatcgggtcgcgcgaccgcaaatcccaccatcgaatcttgcggtcctccgccgccgtcgtgacgacattgtaatcctggttccagacgatagacttgatcgtgccgccgtgcacgccagcgccgatctcatagctcgccaccccgttctcagacgtggccgaagacgggagaggcggcgttgagcccgtgctggaactgccgccccgcgttagatcgaagatccgtagcttcttctctgcgccgcctgtcgcgagtacctgcgggtttgcttggattgggaatgctactgcccgcacgatgtgtgcgtgttgcagtgtgtgcagacattcgcctgtgtaggtgtcccagaccttgctgtttccggtgtcgagattagcatgtcattgtgggatgggggttggggttgcttacgctgagaaatcggctgctgctgtggctgagatggcggcgtcggcggagagccttgcttgccatacggcgcctttgtggccgaggaatgttccaatcctgggactgtgttagtactagcgtgcgttttgggcttggtttcatttgtcgtaccagtcgcccgttatgccatcgcgcagcatggggttattatctttggttggttagtggatatgcggtaaattggggagtcattggtctttcttacctttgcatgaagagatgaagtaatattgctcgtcttcgacggtcgaagagaagctcagatgcgtcaccggacgagaatgtccgtggcacgtcagaggaactaccttggcgatatctgttgaagacgtattagtaaacatacctaaatagtgggtttcaattcccatctacacatatcactcaccggcagtcattttgttggcgttgaaggaagttcccgaggtcccagtagttttgatgttaggtatcagatagccaatcagatcaccgaaacgcgatgtgcccaaccgagaggtcacgacttgatatgaagatacaaatccaggaagaagacccagagagtgttcaatatgtctaaggaaggtacataagagattcgtcagggtcgtcaagtcatcagatatgtggggttcgaggaagagccgagaacaaaggatcgaaaaaaagtggactgaacgacttttccaaccagacacctcgaaaaggagagaaagcctctgggaatatgagactccttcagtgttgtagatgggatatcgaatttcattttcaaacaataacgctggagccgatcatggattaggtaaggtataggctagtctgattcgggtaggctgagacacgtgaggctcacatatgctacggcagtttacgacgaaggtctctgaactgaccattgataggtatcctcaaaaagattataacaatatatttgacaaggcatctagaagaatttctaaaagaggatattaaaaaacatgctcagaatggcatcaaagagagacatgaaaagatacgaaaaggcatcatggattgaaaactatccttgagatacctaatacaacaacctctttgataccagctatgtcccaagttctagatgtcgccggtagaaggtcgactgtgcttgtagtatagccgagtgccccgagtactactagtcctatcctatccatgttgtatattgtgatttatcacgtgattagcttcacctaattggcagccaaccacagaaggtcccactttcctcggccccactcttctcttcctttcctccaaccacacgatctcaagtatactttactctgtatcgttgctatcgtctttcacttgtttctcatcatggcaactccaacgtatagtctatccttagctagtcataatggatcatcttttccgtttctagcttctcaaactttgtcacggtccgaacatttcagaagagcatacagcttttctagaacatgtggaagttgcattaggaaatttagagaactaaacgacggagtctcctccgatggtcttttttggcagtctccttagatacatacatacctttggccgcgaacctctccgctctaaatcacgtgcctacatgctaactatagtaggagctttgtactggcagaacttggggacggtgtatgagcagtcagtatttcggtccccttgtacatcttgtctattcaagttgggaatcaggtagaatgtacgatctttgatcaaaatgcacgtttctcactattggcagaatatgcggcagaaaatctttatagtggcagaattacctagatgcctcaacatctgggcagggggacaatagccaaacgggggtacatatatcaatcccctatttataagtggattaaatgggttcgttctccagggaaactggcacgggttcattgtatcaagtacagatcaaagcaaatgtatcggtatgatacccccaagcaagacggggtaagaggaagagtaaaaaataatagacacgcctcgttccctcattcttctcctggaaaagcgtaagccagacccaaagcaaaaacgaatggcaatgcaagcaagatgagagaagagctttcaagcaaaatgaatgggccggacgccttcgtctccgccgagatgagaagaatatggcaggagagagataaaaccaacgcgaacgcctgggacaatatgtggccgacgtgagccgatgtcatgtccttccgtagctcatgccattgagtagagagagattagaagagaagctaaagaaagccacataagacccttctttttttcgtactttgcatagaaataaacacgcattgcaatagagaaagccaataaatcagcaaatcctttccgatccacgcagacgatgcatcgagaaagatccaggggatagatgtaacaaacagggggaatcacgtagaataaagtagataacagctcgtataggtcctggttagggcaggcagcaaacacgcattagtgtgcattgcctattgagtcaggataaaggaacgaggtaaacgagaaagcaagaaatcacgagggtatgaaggtgtgaacaaagcgcaatggccgacagaaacaaatgcgctctcgagcgcctcgcaccgaccagataagaatacaagtttggcaatgacctgaaatgcaatcctcccaatgaaaaaaaaaaaaaaaaaaaaaggaatgtaagagcgcccaggttcccatgcaacagaaagacgaaaagccaagataaaagaaaaggacgggcagaaaaatcaagggggaaaaaaaaacagaaagcaaatccgaaacagtactcccgagagttatgcagccgccgaatgctgatctagctcacgaaacgaagatccccaaatgcgccagatatcccagttcgttcaaacatgccgggcattatcttaatataacgcttggatgggtttagcgacccatcatgtagtcagggtaaaaggaattatagccgttcaggttcggcgccgcattgttgttaccgccggaattagaaggaggcggcggcgacatcatcattgaattagctccatttcggattcccaggcccgagttggggttgtatgaggtattgcccatcagtccagcatgcgggttgacgggggtgtgtatggaggtgccattgcgcatcggcggcgcaggcatgggcatgccaagaccagggggtgctgccagtccgggagggggaccattgacagctgagaacatgttgttgtgaattccactcaagctgctgcccccagggactgcgccctgtccagaggccgagttggatgagttcatgctgccaggttgaccagagcgcacacccaaaggattctttgagaagctgagacggatgccagtcttgacactgttcgacagcttgtagccgtacaactcattcagcgctttgctggccatggcgacctcgtcgaattccacaaagcacatgggtccgttctgcttgtttcggaaacagagtcgcttgtacccgcgttgtttggagaaaagcgctttaagttcctcctcggaggtgtctggtggcaagttgcccacgtacagagtgttgcaaggagggtttaggtcattcgggttcgcagcgggaaggctgtggcgtggtgtgtgctgggcgttgtatgggaaactatggccttggttcgggtatgcagatgcgggtgttccaccgcccatacgttgcgcgccacccccggggtagttctgcaaaggtggcgacatgttggttgacagggacatattggcaaagcggttggtcgggatctgagggttggtggcccggcgtccggcggagacattggtagaatggccattctctgcatagcccaccggatccttgagcagctcgcctgtctcctcgtccgggtcttcgtcaatcatagacttcccggttatgcgtgggaggttatcaatgccatttccgatcggagattgtggggagaaaaggctgtgcatacgcgagcctgattccgaggttggaggaagtccttcgccgataggctggttggggttggcgttggagagcctctctaagctctggaaagtgccgttgaaacgcgacgattgacgcgcaagaggaccgttcgaggcacccatcagcgcacgactcgcggtgtgatcgatggtgttacggcgcgtgttcgacagattcgctcctatcgggccggggtacatctcgacgaccatgttggcgtcgtttttggagttcggtttgccatcaaggagagacctggcctcttcggcggcttgcaaagtaatgaatcgcgcgatcgcggtcaagaacccgtcatcctccggcaggtccaaggtcacaaagtccgcgtcgacaaagtctttggcgaaaagaagcatgctacgcagggcttcacggctcgtgtttcgcggaagtttgcgcatgagaatcgcgcctccgtttccgcgattcaggccattcaggccctggaggttgcgatcgttctcgcccaagcgcatgttgttatcgaatgaagctgttgtaccgataggggagaaagggtatgagaaagatgggttcatagatgaaggcgcttgcgacgcattcggactatacacgtcggtcgacatcgcatgctgagccgtcaaaggcgcttgcgaagaagggagtgactgttgtgggggtgaaccagatgacacggactctgtgagctgcgtagttccaaaagagccgggactcgtacgagtggactggctagagctgccgctcatccctccacgagattcgaaaatttttgaagttttttttttttcgcctttcgggggttcgcgatcacacaggggaaggtagtccaggtatgaaaaaaaggagtcgcgggagttggaaagtcgaagttcgaagcagtaatcgataatgcgacaagagatcgtacaccaaacgcgatgcaacgatagaaatgaagaaggcgaaaggcgaaggcgaaggcgattagcggttcgatcgaaagtcgagttcactcggatggtgtctcatcggatttgcgacaggttggactatgagcgctgtgaaaacgattgagataaagatggaaattgactagaatggtaagatggatgcaaaagggagaaaggtttgaaaggaggggatgaaggagagtgcaggggagggggggggaagaaaagagtccggaacggtcgagtgccagtccacaagtgccagatccatggatctgcccttcacgacgcgactcaatggggaacaggtatgtgacagtggaggtacatggggttgtatgtggatcctcctattaggagatgtactctgaagtaaatgacagtacatagtcacatcattacacaattttacgtagtcttacacccttagccctggaaactgaccgcatgcagagagttgccaagtgcgtgccccgaggtgacttatggtgaactgtggaatgcccccggttcttttctttcttttcttgatgttctcttatatattagatcgacgggtggatcttgaatgtgtctcttctagaaaagcaccggccatgcaagtgcctatgcggcttgccgtacggctctgcacgcgattggggctctatgaaatgaaagacaatatatcacagggatgttattactacaacataccttatggacttggtagaccaggtatttccaaaccggtaatccatcctagtacctctaggcggtttattggatgaacctggaatacatttacaactgccgttagccgggccagatcataagagccaacggcttgatattaaatatcatatactttccaccatatgtcaatattggagtccatctacggagtaacccattctataaaactaaaatacaaaggtcatcacacacgtccacggaatcacaaaagtcaaaaaccggcgatcctccagggtcactgaccaattgccacgggcccaaccccggtaacacatgggattggctgccacggggaaatgacttggcttatcgagggggcgatggttcatctggttgggccgtggagagaagctactgcctaggggttttattagcactacttcttcaatgtgcctgaactggtcataggcgcgtcaaaagttttgactttcaagtttactgaatttgaccaagttccaaaggtagctaggtatcttccgatgcatttaagattcacaacatacttcgtttgtggtttagtagcatctatgactttacaatgtagacatataggtgtgagcatgggcaagtatgctggtaacgcatagcctacctcggtacggttgcctgcccgatctaggcaacatgtgcccttcactgtaaagacggagtcaaatcgtatcagtagatattcatgctgcggctcatctaccgcgtagagtcagagcagtcaggctgccacataatgtacaggggttcccacaaggcaactcaataacgccaaaaatgccagcaaaatcaggagagaaacaaacagaaatacagcacgactgcctacccgtcatcgagggtgccacgtcttgacctttccaaggttctcggatgttgtccggccgagtacacaaagaatgccggagggcagaaccttgggaaactatgtaaaggtcaagtatcaaagagtcaaggagtcaaggagtcagacaagcagaatcaagctttgtcaaaagtagtaggcttgggcgcaacaaggccagcctagagtgaggttcaagagttagcaaaagcagtccgtataataacaacgtaatccccatcattccatatgatctgctaagaacgcagacccgacaatagccgcccatctctctcggatgctccgattcccagaactctggcggataaagaaaccaagggtcaggcttaccatgcccatcagcttccagacgggatcactaggctgtgcgccgacaccgagccagtactttgcgcgtgaccggtcgagggcaatctccttgtatgggcgggcatcggtattctcgccgtacaagttcgtgggacgcttcgggatggggttgtaggtgccgatgacttcgaggggcttagcgccgcgggcggagctgaagatagtagggtcaatttcaattcttcttaaagatacagtgaatagcagattgaagcactccctagcctggcaactccagtgtttggcgttggagggcgtatcgggggtatccattcacggggaaatgaccacataccgggcttgcgcaacaacgatgttgaagaaggggttgtgcttgttgccaaagcgtgctagtcgaatccggacaaccattttcgcgggtgtgtaatgctttctcaattggaaagagcgcaaggactgttctcttgatgatcccgtctgccctccgcaaaagttctaggatgtccggaagaattattgatccgtttattccaaatatggactagcgcatatatgatgtaatggtgtgaggaccctcagtagatctacttcgaagcttggtgtcactttagtttacacagtttctgtcaatttacccagttagcggaaaaatcagcgctgacgctaacaaacttatatgattcgttctgcattcactcatcttcgcctacctcttcctattcgccgctactgtaaaccagcgataatgtcgttgaaggtactgttgtctgatattagccccaacaacatataagctgacaattattctaggcaatttcagccacggatgctgcatcccttgacaaagacctcatggagataggtggctggtctctggaccagttaatggagctagcgggcctttctgtctcgcaagccggtaacctccatcgatcttgaacatacactcagcatagactgatacaatgagcaatcagtatggaaaattcatccgccgaacgcaggcaagaatatcctagttgtctgcggaccaggcaataatggtgagaaacaccgctgactttgccattccgagcaacatcagcctaacagatcaccaggaggagatggtctcgtagccgctcgccatctagcccattatggctacacaccgtcagtttattatccgaaacagggcaaaaacgagctctatcaagtacgcagcccctcaccagaagaagactagaaggatgaaacatgaaacgaacctaacccaacccagcgcctgagaatccaactcgaaaccctctcagttcccttcatagatgacttccaatcagccctaaagacgacagacttcctggtcgacgccatcttcggcttctcgttcggcggagcattgcgagatccgttcggcgaaatcgtcaggcaaatcgaatccgccaacgtccaggtgctgagtgttgatgcacccagctcatgggatatccagggcggaccgccgaaggaaggacctggcgcgaagtttatgccacatgcgctgatcagcctgtctgcgcccaagccgtgtgtggcgttttatcggggcaggcattttatcggtggtaggttcttgaccaaagacattactgataagtatggacttgatttgcccaagtatcagggcatcgatcaggttttggagattggggttgatgcggaggggagattgtaaggcaacggtgttgttgagcacgctagttgaagttgatttaagaatgaatgaacatttacgacttatctagtgtgaattggaagagaaggtaatgaatagccattgtatgggaatcgcgttgtcgtcgttaggaggtaatgcatctctgatctatgcataccgaataaaaatagcacgtactctcagagggccttccggatctcgctaataatgcccttgatgcgcggctccttcccaggaccagaggccgaggctttcgagagaacactttcaacctcgtagacctccttggcggcgctcttaacctcctccccgagcgctgtcaccagcgtgccgagagcgactagtgctcggtagaccgcctctgagtccttctctccagcgacaatccgaatcagttcctccaggaggaccagacctcgctctgcagattctggggattggttcctaccctcggaggtaagataaactgcgaagttgatgtagagtgttgtgatggcgatggtaaggttgcggtttggtgactctccgctgctggccaaggcagacttcactcctgccaagatttgatcaaatgagcctatggccagatcacggccggcagtggtctcgaataggttagcaaatgtccgcattgcgagcattgcattgttgacgttaagaggagattcaaaaacaccactggatatcacaccggacacaacattttcatctttgtactcggcggatgctgtaaatggtgcagcagccgctagtagacggagaatatctaggccagggagtcgtttagcagcaggccaggttgtggcgatctttaaaatcaatggcactccggtttcaacctcgggtgaagcttggagctgttgggaagattcgagctgaccgcacagggcgacaaccgtttccacctccgaggggctcaaagccacgtcttttgatccatcagacacgagttgcgcgttcaattcctgaagcttctttgtgataactttgacgtttgctgagcggatggagagataggttttctgcgggagcaccttagggcgcggctcggaagcaggtggctgaggctcttcggtcggtgcggcgtctccgggacggtaacgtcggtctgagccccaaggatcagcgcctgcgggttcctgagactgcccaatagtggcaccttgagtattctgagtgataaagttggcaacctggtccaaatacgtcatggggagttcattgtctccaataaacttggtggcagcctcatatggattctgcgtgacattgtatggtagtttcagcggaggcttgccatcctctatgtcaacatcgaagacatagtcataatcctgtccatggtattcggtcttccgaccactgcttccagccgagtccactaccataccaatggcaacccattcctgtgttgccgaagaccaagtgtgggcgctcacagtaccaccaggctctcggatcatttggacctgaccttccttggttccggacttttgcttgagaaattcaggtccaggtagctcctctttattaatcttcccaacttgctgctctggaatagctgactccttgacagcctggtcaaactgctgtacggcctcgggggctgcatgacggtcagggcttctgctgaaaacacgagcaatgcggtcactagcaccggtgacgatatcaccggtctcactgcaagctgcgacactccacacagagattgcgggatgagtgatagtctgcacacactgggtcccgctccatattttcacggtacgatcttcactggagctcacgagctcgccagatgggagtgccgccaaggagtagataaagctttcatggccatgcagagaggcgacgagtttaccctgcagagtataaagacgaattattccgtcattgctagctgaggcaaagtgggctcctgtagagttcgaggtcggaagcttgcacaaggcccggacaacgtcgtttgagttctgtacgcttccgagtagggttcccgaagtattgaacatccgaatcattttgtcagcacagcctagcgtgaagttagtatgtaagacttattagggccgcacgaagctagcatacccgtgatgattgtgttctcgtcataggccagcacggcccagacacttgcctcatgtccctccagtacgacatcacattcccatttcccgaccttccatagccgggcggtggaatcccagctgccactcacgacccatttgccatccggagacacatctagagcacagacattgtggccatgacccaggagcatagcatctgcattatcttctgcacccttgccaggctgtctggcttcaattattgcgtcttgtccagcggaaaggataaggccctctgggaactcggatgtgggaggaatgtaggctaagctgttgatgaaagcgccgccatgtgcagcgatggtatagtcatatgcgggaggtggagtggagacgagcttccagagccgaactgttgcatcacgagaggcggaaaggacgacatttgggtttgggaagaccacggcgcgaacctagatcagaaatcaaaactgcgtgagtagtctgtgtggtttgggggcacggtcaacggcgtcggcacagacgccgggaccaggagccttacatcatcgccatggccttccaaagttgcggagagcttgaagtcaggcatacataaaacttcgagagaagaaacggtaaagaaagaagaatccgaagaaggaatatttcgagggtataacacggaattaatgattaatcaagctcccctggatgttgttgtcctttagtcgttccgggggatcgccccgccgaagcatcaatggtaatatcacgtgggcggtaacgccagggaacctgctggaacacgccgagatcttatcaaatgcaacaggtacggagtactacgtcgattttgattggatctcctaccactatagaattcattacatgctcatgtggtcctcaagaccctatccactatactggccaatttcctatattgacccatagcgtagtaataatagcttcccagtggttctgactatatctagtagatctttagacatcaaacttactgtagcccattgttgacagctctgtgctttatatttgggcttacaactaatacgaaataggattggaaaagatcattaatctgaccgactaaaaagactaccggagaagacaacctgaagactacggccggataagcggctgactatatattcctgtggcagtatgttcaaaagggaggcggtattcatgacagtatataacggacaggcggtacatagggcggtaatatgtaggtacaaaaggtttagcccaatatttcggaggttccgccgtccttgcattgcaattatattcgaatgtgtgttcctatgaagtgtttactttggttgtatacaagtggagatgataccacgtgactacactaccgagaagtttcttcccctgccgacacctacacttcccgctccaacccgacaaactcccatccttcaattattgctgcaaaagggtcaatggcagctggaactccttgattcttaatatccagtgtattccatccagtttaacgttaaattttccttcccattcccccatcatatcctccaagatgccaccccggatgcaaagccggagtgtgtccaacacccttcttccctacctcacatctagctcctcttcctcatcctcactttcctccattccttcattatcctctgcatcatcacaatgcctttcgcgtcaattttctgccacggcagcaccacaggcacagaccaagcttcgtcggcaaatgttcgaatggctcaacaatgaaggatccgttttcaagcaccacgttcctggcgaaaccaattatcttactcgcttaaaacagcgaggcggcaacgagggctcagaagcatcccgtccattccccaacaaccaacatttcatcagcgagcctatcctcagtgaggagctacggaatgaagtctataaccgcgtcatcgaacagaagaagagtgtccgcgttgttagtgtggagcttggaatcgatatgaagcgtattgctgctgtcgtgagattggtagaattggagaagagacagcgcgcccaggtatgagcctcgtccctttctgcttcccttcccttttggactttctttcgaccctccacgcatatgatgagtcacaaaaaatcgattagtcttgaagacacctacatggttaaaccttactttttgaactgaactgcgttaccgttaccttttggattcctatcaagttttatttggtcgcgtgacatgaactgacgaatctcaaatcagggtaaacccctagcactcccatatgctcgggccgtccacgagatggtccccaccacacctctcgccgagaaaggcgagcgtcaaacatatcacgaacccatcaacgacctccccgcccaccccctgacaggcacccaaatcttctaccccgtccccgaatcccgctccttcgaccgtgtcgaggcgggtcgcgtcttctccggtgccccagcgatggagcactccgaggccgcggaaatctcccacccctccgacctcgccgaaaagatcatggaggatcccaactccatcggctgggtcggcaagggcgccaacgcccgccagatcctgcaacctgctgacgtacgcattcctcacccacacctggttgcccaggagcgcgaccgcctcgcgcaccccaatgagcgtcgggctgttgcggatctccaatctaagagactcgagcgtcaggacgcactcgagaaagagcgccgtgagcgcctccaggctcgccgtgagaagaagacgactattgtctcccctgaggagtcgcgcttcgactaccgtatcaaggatactatctacactacagagactactggcgttgatggccgtggttcgaaggctactggtcgtcgctacggtgttcctcaccgtgaccgcacacgcggcgaagtcaagattcctacccgtgtggaggcttgatttatctcagaatagtgccaggctgtttctttctttttcttgtgtttttcagcaactttcttggctacggcctttgtaattttacttgtacgcatactcatccatggatgtacgaaggaggctgtcacttatgtacctatataccggataatgtcgaaacatttctcctttcattttggactccgaagtctcccaggttgcctggtcacgacgcattgaacactcacgtcttcgcccagccctggagggtgtaattcgcctctttgtatgcccacctgggtgaatgaccaaaggttatatagaaaggtccattttatgagttaagcctttttttggccctctcctgctatccacctagcaaactgataagtgggagaagatatctatataactagatacatatctagccctaacataccagtgattgcccaaggttgaccatattcccgaaaaatagagtctcgaatactggccaacgtactgaactgggaaatgctgacggaaaaacacgtgttgagattgagaacgaccttctcgaataaatgttgtcagctcgtcgagaaaggctggttctgtcgaagcacatttaccgcgcgcttctcggatgcttgtttctcgcctctcaaacacttggtcatggcactttctttgtgctatttctggactcgggttacattctcagggaaatgatatacttggacgagtaatcaaaattcttcttgccttcgatttctgcctatctgaccccaggaattcatctgaagctattcttcattcctatccctccgcctgctcaactgcggccatcatgagtactatatatacatgtacaaagaatcggtcctatccctattcaaccccgaaatcccgcaaacatcaatttagtcggtaacatggatgtagcggtaaggcttggccgtgtaactgccaaccttccagccaacaggacgcttgtacgcaacacagccgtaagtgccacggcactcaagggtattgtattccttcttagaactatcggcccacgacttgaacagagtgacgtgaccagcagcaccgccagtaccagcaccaagagttccaacaaagtcaccaggcttgatatcgtcccaagagatggacttagcaatgtcggggagactgacggtgctagcacccggcgaagcggcgtgcagagccatgctaacgaagccggagcagtcggtgcggtacttgcggccctgagggtccgggtagtagtcgctcatggagtatgggacgtggcgggagacccagtactgaccgcgggagagaatctccttgcggctgatcttgccctggtaggaggagctgccgtcgccggagctgccgccgtcgcaggactcggtgaccatactgtccgagccggtcttcacgtagtagtcggcgacgtaacagttgtcggatgtcttgtcccagatggtgttgccgttgatggattcgccgtaggtctggcaggagaccttcacgtcggcgccgcttttgtatgttttgacgactgagtcgcttgttgaggggccggagcggcagttgagttgatcgctggtgatgggatatgcgttggcaatagagaatgccgcggctagggtcagagccaagttggtgagctgcatgttggcaaatagagcgagttggcaggagagaaggcaatgtgtttgaagggctggattgttgtgtcgagaatgttgttcgtcaggtcggacttggatacttatacattgactgctgtgtcgatctttgcccggtgctgattagggtgggatcgagtactatcacgatacggagtagtcgagaagaatttgtctaaaattagtgctagaagcaggacttggatcctctcgtccgcagagagctcgtaagttagtctcatcttctcataatacgaggaagatgccgaaaatcaatcctaccctagggctactaaaatgccattgcagatgaaacgtccggggcgaatacgatatgaagccctaaaggtccggatatgttgccaaaaatagtcccgtttcttcacatcggcctcgtatacaagccgcaagggcgatcggcagggcctaaccaaacacgaggtcgaaagaaaacacgagattacttggcaggacgagatcgacaagccacttcgatgaatgagacgaacacgatgtaacaattattttccgaagatgctaaaaaaggctcgtttcttcactttagcctcggcccatacgagttgcatcaacgatcggcaggactatacctttagaggatgcaaattgcgagagaagaaaacatgaggttgctttttaatatcaacgaacgagataaaaacgatttaatataatggattgtctcggaatagatattctatgagataccaagagctcgtccttcaactttcattcccatcagtacttcgtactcgttgagcactagtctgactcccaagcattcccttctcagctgaatatctctttcttgtagaaatacgaaactgattgctgtttagcatattacgctggctatattttgatcttgttagatcgtgaagttgtcgcaacgcgatgtgtacatgtattgaaggtagccaaaataggatatatatagtcttagaacttgatcagtagaggtaattacaagcagatctcatataatacatatcataatcaacctggaagaccaagcaaaagctcccaagggcgtgactgactgtggttcctccaacaagtcggaggcttcgcctttgcttcatcaaagcccgcaaagctcttgatccgcctcagctgcttccctaaagattgcacatttaattgtatggccttgtcaagaagcaagcctccccaacacccctcagacgcgtttcaaggtcagtggtcaaatccttcctagcctctcgctcttccatctcatattcatcctcttcaatttcgtctttgttcctactccaccagtcaccatgtctgcctacatccattgaattgcttgcttttctggctctcgccacatatatgcaagctgcctcgaggtaaaatagcctcatctcgtccaacacgtcggcaatcctcgccaagtgttcgacatcgtcgacttcccctcctctttctcgcgaagtaactttcttcatcccagtcgtcgtaacagacacaagtgcagttagcatacgccgtatcaatgagcaatttccgctggcggaatctcccgttgtgtagcgcagcatcactcagcagtatcaggtcccacaaagccctggacaggattggcatagttaataaaatggatagttactagtttcatgaaatgttctactagcgaaatacgatatggcgcactggtggctatacactgccgtacgcatggtttaggctgagatagtgtgcgaactaaatgctcctgaagtctctatggacataaataacagcagttatcaatcttgataatgtgcaagtagaatggcgtcgtcaaatcacccccatattcataattctaaatcattgaatactgtatggatatcatatatcattcattcctaaccagtcctgcaaacacttagaaacaaagaaccacgaaaatataaggactagaaaccccgagatattaaaagcaaatgcacagcgccttaaatgaaaaagcaagaggtatatgcccaacagtccgccattccattcagcctccttccattcctatcccgtttcaatccttctcatgcttagggactaaccaaacaaccagatggtcaactctcaacgagcctccccgacagaccgacagcgtcgccttctcgctccaacccatccggagatcgcgtcggattcagattcgtcttccttggaggaagggttgaaaagggagccgattgaggcgatggcactttggatccatgaggtagtagtaggggaggctggagctgatggtgtctttgatgactgcatggtcgagctgagtgagggggtgaatcgtcactggtgagatgcggggtatctggtttgtagtttgtagtttgtagggtgtgagaggaggtcctttggtaaatggtatattgctcgggagataatgatagacgatagacttgtgtgtaggatgtttataaggcgtagggtgtaggtccgcgtatggagaatatatggacgtagaggatcgggggcaagattaaggtatttaaggaatcaaagacaataggaacatcacatgcaggacaatactcagtaagcaaagcccggaactagatttgcataagtacataaaagcccggacttgatattatttgctattctaaaagcttctctgggttgctcctcgtacttggggtcatgttgcttcctcgtgattggtggtatgatcacattgtgcagacctacctatcgacttcgtatctgattgacagccattggacgagttcgttgctttaagagatgttgtgttaccttggatgccggagattctggaaagggatatgggttgtgtacaaggtcgaagctaatactttgaatactatggctaaatgtatgtatacgaatcatcgctcaaatgattagtgaaataagtgcaaggaaataccaccaagccccccagccgataatcggaacgaacaaagaaagctatacattgaagagtataggcacgggacatctcggtcatgtatatgagaatacccattgcatgacagccgtatgcaagagtgaaaatagtggacgagacaaaagaaaccagccacagaaggaaaagacgtgcgtatgtagcagaaataacaagacagatccatacggccaaaataagattcacgagctgcattaggtttgagaacctcgaagtgaaagtgcatgctaccatgacaagaagatggaaggacgagatcggaaaagacacgttgctatacggggtattcaatgagagagacaggaagtcgaatcaaacaagtcggaaaaggatcgatagaagcgtatagggaccaaggcatggtaacccatccaaagacaaatccgtcctcatttcccacccggaggcggggccgtcgcactactgcttggtacggtatctccaggtgttggcaactgcggactcgagagcgagtctaggctgtcgggactgccgctaccccatgaatcctcccgcatgatttgcgcaacatctggcaggtgtggcttggcttcgtggtgatcggacttattagcagggcgggaggtcgagggcgatgggggatccacctgtggtggttctttgcggtagccaccttgcatcgggctggctgatgtgtcaactggcgaggcggggcgaggagagtccaagaagccgcgccatttgcgccagccttcaaagtcaattagggcttgcatgcagccccattctgtcactttctgctcaagccaagggaatccgacgggctattcgagaaatgttagtatacctttttgagatgcaaatggtcgcagtagggatccgacttaccttggtcaggaaatcgttgcatccagcagctaatgcttcatgtctgtcactttgcagactgctagctgtcaatgcgacgataatgactggactccggaacagtgaaagatcggacaaagtgtcctcttcactgaccgtacggtgaaggccgggtcttctgtccgcaggagatgtactggacgcgctaaagcgtccagaggctgtcttggggaagacaccaataccatttaagcgctccaggcgccggatctccttggtggcttccaaaccgttcatcacgggcagctggatgtccatcaagaccaaatgaaatccaccctgtcgccatttccgcactgcctcttcgccgttcattgcacatttccagcgcactttcaaccttttcatgaaggcctccaaaagcttctggttgataatgttatcctccacgatgaggacattgattggcggaacggtaccgtcaatcaacccgccaaacatagcaccaggtgaagtggctgcttttgattttcggaccacgcgtggtgatgcagttgccgggggagtgtgtgatttcacctgcggagactctaccggcggtgctgacggtgggggtgtaggcactgcgggagcggagggaggcgggataggttgggaatgaggagtagcgccggtttctatggatgtcagtggccatgtggagcaaaagcaaagtagtctggaaacgtacccgttatgccaggagtttgggtattctggttatgaagaatagtgggagaatttgttttgtgtcgtgtcaacggaggtcgttgctgatgccgtgccctacggcttcctggagatggcagtagaggaggagcaacaccagtgttgagaatggaaatcgacggcgcagtagccgctgctgatgcagaccccgagtgtgcagagggtgtgcccgcattcgcattgactggcggcatgagagggaagtaatcgccatgctcgccgggttccgaatggtgctggtagatcgaatggcgcggcgatggctttggggtgcgccgtgacggtgcatcgatcaccaatgcttcctcgattttttgtcccccaggatagtatgcatcgagaatagatgacagggcttcctccgggctcaaaaggcgctcagtgtgacctggtcgattcgtaccctctcgtggcgaaacccggatagcgatgtcgggcgagtcaaagcttctccctagtgagtttccgtacttcataatgacttggtcgcgtagctcatccaccaccgcatcgtctctgcacggcaccaaggtggccgatccaccgggccgtttgacccaaacccgacgtgtgaccatctcgtgaggaacaaggggagtgaaaccactaccctggtcacctgaagagaaaagactcgcgtccagtagcccgctaatcaagtgttgctgtgtcgctggaagaagagattgacgacggatcgcaaggctcgggcgcttgcttgatggaggaaagtaggaggtagaaggtcggcgatcattcgtaggccactcgacaacagtatccaaggctggagtcaatggagtctctggtaggattggagtttgagctttcaagtgggtggactggaaggaggtggtatcggaatgcggaggagtcgataacggaggggtttcgaggggagacggaggatcggccgagataggagtcggcaaggaggaattatacggctcggtcgacggcgtacaattgcgagtccctgtgtgatgaggttgttccgaacgcgtagacacggaagaattcagttcctggtttgtccctgataggggttccttgacttggcggtcgcgagaagaaccgatgtccaaatttgaagatgcgatgctgtcggatctgttggagtcaagagggcgcgagggggttttctggttgaagtgggcactcggatccgcatccgcttttggagataatcgtccaagtaacttcgccttcagacgtgatatccgttctggcatcgttgggtcttcatttctgacaagtgggagaaacacaggttgtcgttattctcccggataaggaaaatttcggagttttcgtacttttcgactttttcgtacttttccgtctatatagcttcaaaaggcaaagaggtcaaaggtcaaagaagttgagaggggaaactgggacttgggagtcagctgggttagttgctgatcttccggccaaggaaaaaagctatggccttttaaggctaatgctggactaacctacaaaggactgggggggttatttgggcatttggggtagacaaacacaagacgatacaggagaatacatatatcacaagatcattaggcatctagattgcggggttcttttctgttaggcgaggtgcatttcagctctacatatatacatagcagtatgcataggagccttaagcttggatatagcagtttcattcgcagaacctccagggcttgcgtgaactgagcatagttaaaccaacatgaaaaccatctgattcatattcaacataaatagctgaacataaatgccgataacagtatagccactacacacaaaacgacctagatggcacgcccagaacaccagtgcttagccagagacagggccagtgggttcttagggtcactggaacattccgaagagctgcatctgcggttgcacaccctaacaagatataccatccatcttgtcctgtcggttgggcgtagaagttgacgttgtcctggttgcacacaacatatttcccatacaaagtccacacattgctttgtggtgccggtacgcttgtgttcgtggcaactgtgttgttacttccctgtcctctcggaatggtaaatatggctggacaagccattaagccagtatcgctcaatcccaacaaattggtgtcagaggccacgccggctgtcatgaatagtatgtcagactcagtggtggttgtggttgtggtattggtattggggtgagcaattgggacatccgtcatgaggactcggaggtcaaggcctacaaaaaactgcgaacttgtttgctgcgctttgacagtgacagatcaccgatctgggcttgacctattcgaccaatattattaggtggtgatccattcaaaggtgggagatgtttaccatctgcatagaagacaggcgtcgatgctcttgccatatgcatactttgatagattactgccgtgtatccagagtttgatcaagacgcattcgaaatcactttctatatatctatgccccggagtgccttgctattcccttgaaagcgcagacagacgaacccagggctggcttggatattacagaatccttgatcttctcatcttatacttcggttaattctccccaaggccaagacaaactagttgtatcatgactagcgacggaaccttggaatatcaatacactgactaactgttaactgaaacatagatcccatccgtggtgctctgcaagaagagggtgttggagatgaggacgaagaaaggtagatatgacacccgtggatctcttggaaggcaccactcattctgaaataggaaggaagggtctgccacaaggtaagagcgtccctggagttctgtataaggaaggaacgataaggaaagcgagcataaaaggaacttcaagtccagacatagcaacccccaacccccatagctcagatgggaagtgccccgggcagggtaatgttaggttgcgtgttcgaatcacagctaggtcgggttgaagaactgtgagtcacgggctgacgacagggagtacaccaaccccatcttgaaaagggggctccctgatgcctcaacgtcctgagcgaggcgcgtcctagccgatgaggaaactgtccctagcctagctgttgtgaagatccttggggccaattttttttcttcttctacttcgggatcccttgaagctattcacacttttgacccaccaccccactgctacgtctcgtaaacaaaaaaagaccaaagtctgacgacatcatcaatgagctgatacagtaccgcagtaatgcaaatatctagcgattatcataacgcaaagtataatatagttatttcctgcttatatgctgccgtactagagtaccgacatcgtttgtctatttgctctcctacaacgtaagtacacagccccagcccccacctttctaggctacatatagcgctgagccagtgcccagtcgctactgtgtatgaatataaagagttggagtttaccgcccgcatgagggggccaaaatgcggctgaaaccagggcaaacatcattcgggatcgaaccttgcctttcattttctcctcatttgatgctatctcaagcccggcaatgacaaaatggctaccaatatgacagcagcatgtctggatccatcagaagcgttccgttctgtccacacgctctctcattgcttccagatctttggtcaccaagacaacgatttcttgagcagtgatgattacaagagtcttttcgtgtatccaaatgacaccttcgggcttatgattgacgactgcatgaaacagtattgcctcaagcccgatgctgaactacttggttgcgcgggaaattctagttttgtcaactcccctggaatcggattaagtaccttacttgacccctattcatatggcatggtcatatctcctttcccacatttcatggcatctggttgtgattttgttaaattggacttgaatgaggatatctctggctccggtgaaatcctctcctatcgccctttgaatcttgatttcaggaaaccacatgactgatcgaggtgatatagatgataattgcatatatcatgcaggccctgattctgttctatgtctggctagtcatccaagttttacaactggttcacgtctgcacacaacgtctttctcgcagcaagcgaagaagctaacaaatgccctctgtctcaagagatgcaacgctctctcatcatgtgtcaatcatcaattctatttctgtcgacttccaggagtcccaatgtttctttgtcatctccatccaggccgccctgtttgttgccttatctggcgattcgagtgtgctaggtgcaactaacctgacacaacttcgaacaaattttgcagaggccacagggatgtcatcaaagtttatcgtaagagtggcctttggcctatggatcttgcacaggtctcatctggactcgacatatatcttgttttggtccgtggccagtattgtcatttcaacagttgcgttatttagcaagacgtgggagcagccgaatatcactgggatcgatcagatttccgacctcgatcgtttagataaatgtggacacaaccctccacccatcgtctactgcgcaacaggccctatatctatgtctcccttcttccttcactttggtccagtggatgtcttctatttggggagtgctggctctccaaaaaattatttcttaccattgtttctttccagcttactcccgtgtccaacatactattaagcaagcccgagagtccagaactgtccggattctctcaaggttatggacggtgctagcggagatgtaccttcttggcgtcaatatcacgttcgttctccccgacatactgcaattctcccagagatcgtattatgccccgacagactggactttcggtcaaattatcgcagtgacaatctgggtcccaatgattaccagatacatatactggtctatatgtacgtgataggacctatgcaaccctgcttgatttctgattactgacccccagcaagttggcaccgattcttattctgcgactcggctctcggggcccttccatatcgtacaagaggaggttaaaagcgactcgccgcactcgcccggtggtgtacaactgtataccaacctacagtccaacagtgatttagaaatccggataagctcgaccaggtcccggacatggaactaatatctcacccgatatctctgtggtgcgagtgtataccactgtattattactagttagcacccttaagctatcggttctagaaattatatccggactagagaccttctaggtaataaagtatggatcctataatcctaagcgattataactaccgtaattctaactatcacactacagtggttccactagttcaacatagtctaagacagtctctctaaggtttcctgacctttctcatccagattcgggtactgtcttagattacacatgtccgtccaaaatgccttagcattttcgtgcgcctcgccatgtacgctgaagcgctcccggagcaaccttttccattcgacatccatatctgtaaatccaaaagaggccgaaacatactcataccaaataggaaaaaaggcagcgtgtccccagtcgagtataccaacaacctttccgttttggaccatgatatttcccaaattgagatcgcaatgagtgagcacatagggtccgcactctggtaagcgcttcttcaagttctccaaaacttgttgagggagatggcgaaggttaagggccagggcatcccagagctcttggtcagagtgaaacggtccgtggggttcaagatcgaaaaacagtaagcccggatagcatggactttgatcgacacactgaatagaggctgacgtgacggatcgaagttgttttcgcactttgacgacttgatctgcgatatctatcttttggggttctgacaaagaaggccatgcctcctcgagcgtttggccactaatacgttcgttcaaaatgaagtatcgcccatcgcgatcgacccagtctcgtagaacctttgggacggggacgtcggtataagtcgccagatggtttaatgttttgacttcaacttttgattttggaccctcgtctggccgatctttcaaaatcacatctgagccgatggaccagacgccccgcgtagatgcgccgtagaagagtttgaggtggctagtataatggcaccgcttttctttgtcaagtgtccacccgcatgcgatacaaccattgtcgagtggttcacccattgcggatagagtcgatttgttgcaagagatggattttaacagaggattgaaaggagaataaagggaaattttcagaggggaggcccttgctcagcactgcatattttcgagaccgaccgccattcaattggtgtcacaggtcccttatagtatcagtttcatatcagtcctcttgtttaacaaactacttatatcgtaagcttataaggcttttattatatcgctcggcttagtcgatattaagcacttagtagataagcaaatcatgtaaagaagttttacttctggagaacctataaggtagctcctaggggggactctctccccgtcctatcatttcgttctttactttctatatctagtagccacccaaggcatcacttactagccctggagggcttagcactgctttgtaaagcccactataggtaggttctaagtagtaagcgcttataatacttataaaagtcgcttttgcttctcttcgaagatctttatctactattagtagtaggattaaggttcatattctggtaataaatcttatgattcatagtcaaacagatgcaaacgtagacatcaaatagggcacgtagtctatataataaaatatattgtgtgctcgaaatcagctgggtgttctagaactttggaggccccacgcccaagtgtccaggtggattcgacaaattacgtagacgcacacgtagtccacgggtaaacgcacaacacggtgaattgcactgtctacagtcaagacatcgctatcctagcatatagacaccatctcacatgtttatttttctttcatgtacggagtagaaaacaagtgtttcatcgggatcaacagaccccgattataaaccctattccaacatgatcatggagaatagcacctcagccatgaaggagcataaaggaaagacacaggataaccacccgctagagcaaaaacccaaaaccccaaatcacaaaaataaaagtaccaagaagagaaaggacatgcaacacagaacagaaggaggccatcaagacatcacgttaaaaggaaccaaaaaaatacacacacacacacatcgaggttggatccgaagggtatcaaggggaagggaaaacagattttgcgacagaacaaatgacaaggaactcggacaaaaagaagagacatcatgcatacggaccagagatcacagaaggatcagatagttcgagggcgcaatgccagtatctccattttgcttccgagcctgccaccatcggccgctcacatcggatacttccaagatctcgtgtttggcgaagctgatttcattggcgtcttccgggttggcgtcatatgagtagatcgccttggcccggtaagggtattctgttggctggggcacttcgcctacttcttgctcgccgttacccggagtcgagggattgggggtaccgaagcgaggcgcagaggatgctcgttcggcgccgggcgcgccaccggggtatccggagacgggggacgaggtctcgaagccgcctagttgggcggaggtgtacatctgcggggtgttgttggttgccacggtatctgggcgggcgccgaatgtgctggacatggggcgactgccgcggtaggagggatcgcccggctgttccttgttcagggcgaacgagtcgatgaagccgcggtgggtggcctggggtgtggagccgaagtagaagatccagaggatgatgatcatggaaaggagaatgaagcctgcacctgcggcttgcatggaggcttgttttccgtagatcaggttgtttgcgctcgtggatgttaggacaaggccacaggcaaggtaaccaactatctggagacattgtcagtactagagtcttgtaatgttctgcattgaggagccatcatactgcgacgccataaacgtggcccgtgtcagtgccaaaggtcgtgacgaggcccacaatgacacaaaacatgtatgagatggcccaccatgagtagttgggatattgggtttgcacgtcggcgatgatagatgagatgaaagcaatgagccatgccagctagaattgtatgttagtctatgtcgagtcatggaggagtaagtcgaacgaacaatcgaaatcgagatggtcatgagcgcgaatggatcgcctagtatgttgctaggccggaatttcgccatgttggatttgcggattgggttaggctgtggaatggaattggtatgaaataatcgaagaaaaagagggaatggcgatgggtgatgagcgatgcgcttgtatataagagttgttgattgccgggtcctgaacgaggcggacgggaaggagtgactgcggttagttagtgtgggaacgacaggtgtgactgcatgtggcaatgaaatagagcgatataaaagaaagacatagaaagataataggattacagtacctaaaaccggagtgggttcagagacaatccgtggggatggtaagaggttgggagtcaaaagaaaagaatctccttgcagagagaaaaagacagcaccaggctggaaaaagaaacaagagacagaatcaatcaataaaaagaaaagaataaaagagtggataagattgacagtttgaaagagaggaggagagagagggaaagataaaaaggaggaaaagtggcagatacgcagtggagtccgggccccctggaaatcgacggtctcgattctctttggaaattaaggaaatttcaatggaaattgcttggacttgatcggtttgagaatagaataaataattggagaatgattctaactgtttacattagtctatttacttttcctcattctctaaacataaacaatgaaaatgaactcgatctggaaatctataaatatccggttagtcacctccgctttgtgtcttaggtaggtacctgaggtagtattccataggccatattatgagaggcgatcttcttgataccttaaatcggccaaaataccatcaattcgggcctatggcgcagcggtatgttactaccacttcaaaggtgtccaattcaattactaatgatcatccaggtagcgcgtgagattccagacctcaaggtcatccgttcaaatcgggttgggctcaactttcttttctttttttctttttttggtttggtgggtttgaagccaaaaaaaaaaagagaaaaacaccaaaaactccccagccttggataaggctatattgtaggacatataataggtatgctaacctaagtgtgtcgtcgccttggtacggaggtcttgcgggttacgaagccctagtggccggtacctaggtagcttcgatagtacacaacctagttatgtaacgattcgcctagcgttggccagataccttcgaactccttaaaaagaactgaaaacaagtatgtgaagattgcagggacagaattaactatctcggcgccgcgcttagacatctctgatgtacagggcacatagagacgaccttggaagctaaaagggctgagtcacacattttgccgggctctttatacctctatgaacaagttgctgtttaccggatatgtacatatatgatttctgcatgtaatggtgccaagcccaccaccacctctgacaatagggtagatggtggtgagcttggcacaagtatacttagtactctaacactagtggcctattcatgttagctgacgcactaccattggatatcattcctagagagctccatcctaatcctgacaagttagtagtcaatataccgctttctacaaccgagcacagtttgcgggggaagaaactggggcaggttagcgcattctagttgactttgaacgtcccaaggaatccatccggatgaaatgacgttgagaggaatgtactgcaaacacctaattgttacaggaggggcctagcctgggacatagctttgtatatgccatgctagactgtataaacttcgcagcttgacttgactgagctggagactatattcccctcagacgtaaacccgaataccaagatatatacgtatgtacatacatacgtatgttaaacttatgtactccgtaggaatatcccatgtgcttattcgagataagaaaaaaccgcgcccaaatcagaggtatcataacaaaaaagcagacaacagcaacagccagagacatcacacccctccagttgctccccataatatcatccaaaacagtaccattccgaaagactcccctctaagcttcctccctccccttcctaacaacttcccccctcctaatctctctctccacatcctcaagtctcccctcccactcagcccagcactccccactcccaacaagcccgacgtcataccagcgctgcagcacgcgcgccgtgcgcactcgcagctccgagatctcagctgcctgctcgctctgcgtctgcgcgagccggcctagctgtggctgcaggtcgattagtgctgcggagctctgcgcatccggcacggggaggtcgtttagtgatgtaaggcgcgaggcggtttcagggaaggcagtggcgtaggagaggactattgaggctagggtttgggttgtgaggccttcggggatttcgtggggtggtgttgtttggaagaggtcggggtttcggtcgtctggtaggatttgtgttagtgtggaatcggataagatggctcggaggatagtggagagtcgattatgcagatgtcaagaatcagaattcaggtagggagagggtaagaatgagcgggttcgtggcggtggtaatgcgcgtgtaaataacaccatcgctggtcacatacggagttgtagaacatcccgtacggctggtacacttcgactaagccgttctaattctgattctagccgcgctagtcggcgggtgactgtctcgtcgagggatgcgggcttttcgggcgcggtagggacgccggtccagtccgtggcgccggtgaggaggtaggtgaggcggcgtaggcgcgcctcgaggagctcgatggtggccccggccactgcgtcactttcgagggccatggtttgtagagatcagagaccaattggggtaattgcgagattgactgagaaagggtgccaggagcttggtgaggtgcaaacatagcaaaatgtggggacaagcttatcagttagctgtacctggatactacaaagtgtacgtcgtacataacctcaggaggcttttatgcaaggatcggtctgctataatatgggattcttcttgtaagatcgatgcttaggatttgggtgtccaataccgtctgaccaattgacatatagccgaagcttgacattgctctacagtatctacatattcatcattcactcattattcataggcttccccgcatgcttcattcaatgctacttcgcatgccctagatgatgcgccatttcttcgtcagcactgttccaccctgagtctgtctgtgggccaataggcgccgtggagtgagttgcggcggcatgatgacccaggagactcgctccaggtttctcctgcatctcttggctggattttggctcgtcatcgaacccggagacttcatagtcaaagacattcacctttgttgccttctctgacatatcaggctgttgtcctttgtgttgagtttccgcattgttcgcctccgccccggaatcttcctggtcactgaagattatggtcggggtattcccaaattcgtccccaaaagcatcgttgtctctgttcacgaagccctgctttcagttagccgaaaactctagaactatctgaggaagactgtgagtctcacctgaagctgtgacggcgcaggatccacttgtgcattcacagcattctcgcttgcatagacaagtaagacagagctccactcttcacgcgcggcttggaggacttcattctcttgaacttttcgaacagtgtagcccacaacctcgccatcctgtgtggctgcagtgttgccttgggttttttgtttttcggcttgtcgggcttttccatcttccgccgaaaagctgatacgccaccactggtagtcattgcttttttcagtttccgagtccatatccatcaggtgccctggggcagttgttttcggatttgataaaacgtaagtcacatgtggttcggtgcatacgcctcgtagcgtatacttgtagacagggggctcaaaaggtgacttgggaggttcggtaagtgtctttgatatctcacggagagacttcatggcactctgcttcctaagttcgagttctgcgctcgggttattagccaacagcatgggtatggtagtaatggctgtctttacctttgagcttggcttctatgtttgtcgaaattgctctcaattcttctgcgactcgcgttgtctctgcatctgccgctccagagctggactgatcaggctcgctcatttgccccggcgcaaccactgccaccgactgggcagcttgttcgaggagttccgtgatcgtcgagctccccacggggtcccgtggcatggtgtagcgatgaatgagttgttcgagtctcaatacatctccctgtatctgctgtcgttttgcacgaaattcacgagcaagatctcggcagctgctaagataccgatctggataaaacacagaatgaatatccacgcccacaggttttggcttttgaagagcatcgagtctaacgactagcacctctgctaaatgttcaagccatgcgtcatcgagctccttccctggtctgtcaccccataaagcagaatccaaaacgtcatagagtgtctggtcattgtcctgctcaacaggaggctcaaaagtgaagagttccctgctatcaggctcagaaaactcgtggaaaggttctttcctgtatgcatgtgatgtgaatatggttgccagtggattttcaggatctgccttaatggctgcaccatgccatgcttccaaaaacctggtgacgacctcctccgaatctgctgataaggatgacatgctgttgatctttgccaagctgccgctgctgccaaaagcacgtttcgttgtatccataaaagccatcagccgctgggtttcgtgaatgatatcatcccagtcgtcatccccggtcttgccatcattcaccgtaacgatctttggcaggttaatcggttgcccattccaccactgcgggtcatggccgtagtcaaatagcggtttgttccgcaggagcaaagcttctcgtgcgaggggaatactatggagaattgtcaaaagccctccgaggtaaatgccctcagggttggggcggatgaacgcaggctcgccctccgctcttttgcggtcttccggatctgggctaatcatgacttcttcggaagatgtgttgaacaaggtcatcgcccaagcaccttcttcgtagtggtctcgagttgctttgctgaactgcggctgtttctgcaatgtcaccccggtttcctgctgtcccatctccgaattcaatgacatagcaacggcttgctgtaattccttttcttcccgttccgccagactaaggccttgtccagaaccttctacattgtcaaatcgcaaatcagtatgcctcttgcagtcgaaatgtcaagatcataatacctttcggagcggtcccaatggaatcttgatatccagtattttgtcctgggccgcgtatgtccgttcgggaaggaggacgagagggcggtgctgtcgctggaattggtggcgcattgtcctgttgggcaaagtcccatgctggggcggggtatgttaattgcaaaaccgaactcggataagtaggtaatcttacaagagcttctgttatcattccagtaggtaggtatcggctttgagatgttagatcatagccgggagttgctgcgcgtcaccaaatttaccttgagctgagaccccgtcggatcctcgaagtacgcgttgatcgctttctgtgagtcgaggttgtttgcctgtaggagatgatttaggggagaaaatatttatcaaccaggtgcagcttcctaccttcaggaagtcgatggcttgctcgcgcgtcgtgcttgtgaagccgacgaagtcggcgatagcttcctcggtcggttcggaggccatgtttggttctgcgctggaactgaaaatcaatggatcaatgtacaagcatgacaagagatacaaaaagcaaatagaacaaagcaaatgaaggcagaagagttgggagaagaggaagaaaagacgaaagacaaagtgtcgcaacggagcttccccaccacatgacgccaagcgtcattccgctatttgcgtctctttgtacttctgcttctcctggtccgattcttcacttctttgagcctaaaatacacggccattctcccatttctttcagctctcagttccaagtttatctagtttcatgtgtgggactagtccacgttcacaatggatacacattgtctctctttcgggtgcttgaatggcctactccgggtctttataccacaatactatttatggttgaaacaaagcagtgtctaatagtacaatagcactcgggttggaatgagagcccaggcgagcgagtataaagacccttcttttccgcgccagattatcaaccatcacacattcgaaacaacacatcatccagcgtccagcatttcaattccacctttacaagccttcataaattgtcttattatatagtcacaatggctgcaacccacagcaaagcaaacaacacgactagcacagtcaataccggcaggaccgccaacaaggtccagaaggccaagaagaccatcaccaagaagaccactgacaaggtccagaaggccaagaagaccatcaccaagaagaccactgacgaggtccagaaggccaagaagaccatcaccaagaagaccactgacgaggtccagcaggccaggaagaccatcaccaagaccactactaacaaggtccagaaggccaggaagaccatcaccaagaccactactaacaaggtccagaaggccaggaagaccatcaccaagaccactaacaaggtccagaaggccaagaagaccatcaccaagaagaccaccgagaggaaggccggcggaaagactcccttttctcctgtcgacctggagaagcttttcccaccctggggctctgaagacgctctgaaccagacggcgaacaaggaagctactgatatcacccaagccgtgtactatgatatcaacgcccactgcaatctcgagagacttgcgaaagagaaagcttccggtagtgaagagaccttttccaacatgcttgtcttcgcaggaggatttgtggagcgggagatcggctactacatgtcccatgtgaaatccttgaaggcggagcatggtgagttccaacccgtcacacctaacagtaggttcttcgagtttgttactgggctcggatggaagatgtttgctatctgttcccatagtgaagcattccgatgcagcatcaaaagagccagcgacagaacctgggggttcctgctccagaagattcaagagaacttcgtgagtattgaactttttgcgcatagccgtgccctgaagtggcgtgacattctctatgcccacaaggactaccccatcccagggcttccagatatgaaatccgatatcaagacatacatgaggtggaaagtcgaccacccccaccacacggttatcacgcttgatggtaagctgaaggagcccatctataacggcaagttgcagaaacacattaacgagagtatctatgatcccaagaagtggggcggcaatgaacaggacccgacgcttcgccatacacccaatggcagtcccaccaaggtcggaagtgcttgctgtatatgtggcagcactgtttcttgtgattgccgcttgccaactagcgcaggagagctggttgaactgcgagaataccccgatacgggtactggtgttcgagcgctgtcgagattcaagcatggtgaaactctcgatatattcatgggtgagctccttcccagtcccgtagaggatgtctatcccctggatcaagacgatgataaaactggacccaataagcgcactttgtgtacgatttgcccccacgagtttggcaactggacccgctacattagccactcgtgccagccctcgacgcagttcaaaactcgcaccgttggaaaccgagttatttgcacagttgatgtcattcgtgacattcttccctttgaagagattactgttaactatggttttaactactggggaaataaagactttgactgtctatgcgggcactgtgatggttctgggccctaactaggaataggccaatcctctcataggttatgcattttgaatttcggagttgactgattttgatagcaaagaatgaatatagatctagcagtgttttcttttctttttcctttttcttttcattgttctaatatgttgtacatcccaaggccaatgtagatttagttcctcgggatccccgcacgtctaaaagtgcggggaaagctatgccgcggacctactccgcctttgcactcttgaatccctttccaactccccttatgattaattgctacatattgtagtacccttttcggtcgatacagccaattgcagccatcagagtcatgagaccttggtcaagctagcattggaataagaacatgagctacagcggaattgtaaccgggcttggcctaagaggtcgtgtatcctgtcgaagatctgcgttcggaggaaagagaatccttcagcaaccatccttggttaagagggggctactgacagagagctatgcacgggggccatcaggtgtgagtatccgctgtccaagaacaatggcgtgcagtatgtctctgacagtagtactttcaatatagccgcccttgatcgagtccacagttggcgaacacttcgccaagattgtcgcggaatgcggagatagaacagcgtgagaaccgtgtcgcaagattggacaattgagacttgagatactaactatactgtcaagggttgtctcaagacatcagaatgatcgggcaacctatgcatccttggacacaagaagcaattctctcgctcgggggctggagtcacttggtgttgggaagggtgagcgggttggagtcatgcttgggaactcgatggaatacgctgtggtatgttgggtgaccgcggaaatgggtaggaagaaaagagcgaggctaatatccgtgacaaggcaacatacgcgttattcaaacttggtgccgttttggtaggtcagctctctcattgccacgggatcattgggtctaataatccaataggttccgctcaacccgtcattcaatactgcacaagtgattgcggccctgggtcacctggaagccagtcatctcctaatcagcacagagtccaatctgccacgaaagaagccacgcagcaatgtccctttactcaatgaccttgttgaagacctccacaagtcgaagttggagtccgcacctgtcccgtctctgagaaatatcattatggtcgacaactccgaaggccgcgtggatatatcgtcctataagagcttgacgcagtatgcatctattatgtcccagcttactgtagacggcagcccgcttcctcctcgaaacctttcgccggatgaaactgtgaatatccagttcacctcaggaaccacatcaatgcccaaggctgcatgcctcacccatcgctccattctgaataatggctctcagattggtgaccgcatgcttctcacgccgaatgatattatctgttgcccaccgccgttgtttcattgcttcggcagtatattaggctatatggcgacagcgacccacggctcagccatcgtcttccccagtgaatccttcaatgctcgtgctgcgttggaggctgtccaagaagagaaatgtaccgcgctatatggtgtaccgacaatgtttctcgaggagttaagcttgatcgagacaggagaagtctccagcgagggattccaacatcttcgcacgggcatcgctgccggaagcagtattcctgccgagataatgaaaaagctgcataaggtactgaatttgaccgaattgactatttgttatggaatgacggaaacaagtcccgtctcggctatgacaacgactgatgatcccattgataagcggatctactctgtcggaaagctcatgccacatgtcgaggcaaagattgtgaatccggtggacaagaacgtaattctacccatagagagacggggtgagttggcagtcagcgggtacctgctgatgaaggaatactgggccgatccagaaaagacagcggaagtgatgattccggatgattctggcaaagtgtggatgcatgtgagttcaattttctatttgttgtctcgagtaaagctgtttcctctgaccccggggttttagactggagatgaagcttccatgtcaccagatggatatatcactatcaccggacggatcaaagatctgataatccgtggtggcgagaacatacaccccctggagattgagaattgcttgttagccaacaatggcgttgcagacgtgtcggtcgtcggcgtccctgacgtgagatatggcgaggcagtagctgctttcattgttcctcgggaccacagctcaaatacagtcactgctgaggagatccagcaatgggtgcgtgaaaagctcagcaaccatcttagtaagtcgtatcctaggcaactgctttacgtcgtttttgaactatcctgacaattgtcgcgggggctgagctgatgttttgtctgtttacagttccgaagcatgtcttctttttgggccctttggagtctttccccaagacagcaagcgggaaaattcagaagttcaagctcagagagacggccattgcacttttgaccaagtgcgctgcatgaatagccagcataaaggacaaggcctgacttttacgtggattttaggttgatgagtgctttgtacatagttatgtagtgctgtatatactgagttacaagtagtggaaagacctaaagtacatgtacttgagggtgacatccgtcatccgtcaccctcaagaaaaaaaaaattcaaactcgaggactcgaagagtcaaggagttgatgagtgtggtttcaaaaattcccaagcatgcgctaaggcttgcttgaagcggtcaggttggtagttttcaactagcaaaaacacgatctcggatttctcctcactgatacgtgtaaagcacctgcactaggatggagaaagaaagaaagaagaagaggaagttcagggggcaggaccaggtatttataattttccagtggcttaaggctgcgacaaagaaagggtaggcaacgacaaacgacaaacgcattcgccctgacaacctgcacctgggcacttgcacgcgctttgataatcgctgattcagggtccgggggggccggccttataaagagggctaggggaactacgacagtagacaaatccacaatgtagtacttagaacttgaaaggtaccaaagacataagaatggaaagactctggtattttcctacgaataaccttggaacgtccctgatatcatctgacaaatacatcagatcacccgtggacctaggtactcaaatcccacaaggtctgttgtcaagcatagaggccgtagcggccgacgcttgttgtcgagtaaagagtgatcgcgtggaccagctatggaattcgaccaatcgtatattgtccaacccggaacgtctcatagaactgaggctttcaacaatggtgtgagtgcgagtgcgaatgcgagcacctgctgtctctcgggatagcagcccgtggcaaccagcggccatcgcagacaatattagatcgtgccgccacatccacatcacaacgacgaacagagacccgtagatggggcagaagactcgaaagcagggccaagtccctctttttggccgtccgagggtggggtacttcagaggtagtcgacagaccactggcaatattgtatagcatcacgtgtagccagcgagcagacttcgctgtaacccacaggtcaaagacactgcaacaagtttttttttcctaaatctagaaatcttgaatgcctgtttcaccctgcagatttgggcgagcgtcgtccccgcgagtgctgtcaaccacccattcaggctcctcatcctcaaaatactggtcttgctcatccgtgtgatcgtcgaggtcgtcattttcatcaaccgtcttgtaatcgaaatcaatgtcgttgccctgcatgaaacgcaatcccatctcccaccgccagagccgctcgccttcttccttatttggaggtatttcatcacggtcctcggcgaggatctccccatctgggccgcgggtgtagctcatcatagcgttagggtctgggtttgcgatcgcatcaatcttggcctcggaccgtagaaggtcggtctctaagacacctgagaaccccttcgctcgcccctcggcctctctttcttgtgctgtctggaatcggcggatgaggcgatcgtatagtaacgggtctgtggagagtcgagcaggattagcattgtgtttctcttttgttcgcttctgtatgtaaatccagctggcaccagcgataaagcaggccgagcaatgtataaaataatcaactggcaatgggagagaagagagcaggcggaccggctagctcaagccccgctgagaagtattctgggtgtaagtccagataccgcttgcgacggtttttgactttgacagcgttctgcgcgctggatgcatctttgactgaaaacccggaatccttggggaaatgtggcatcttcggtgtgtttcagagtgtggaggtggagaggagaaggaagttgggaacgcggagctcggcggcaaaagttgccttcttctccgcaataacttttttctcgttgaagattattttgatatgtgtctgttctgaacgtgtaagtcggggatctgatttcaaacacatctttattattcattggatgtcaactgcaataagggggaaaaggacacagtttcaggttgctaacaagcttgcagatgcgctatcttggttgattatttttatatcaagaactgcgtcagctgagaatcatgtctctccaggacatgttgcagcacattgatgcccggcggctcactaccggcgtggttttgctgatcctgcttgccttctactcgcccctttcgaagcttgtcttgtctccaacatatggatcctacgcagcgcatatcttccatagttttggagtggccatctccggcggagtcggatggctactgaaagataagattctcaagcgtctaggtcgtctcggtggtttcatgctccctgtgttggcattctgggttccgacactccaatacttcatcaagcagcaaagctccaagattggcaaccccataggcccggtggtcacggaactctgcggttactatcctctagtgctgttgaccgtagcctatgccggaaagcaaatccagactgctttgagacttgaagcacagggtgacctgattgttgagcatgtgcccttgatcggtacatatgtgttctattcggctggcgagcacatcgcccattttgttctttcatggattgttggaacctcggttttcttcaccagagtgggcatgcaaatgcttctcgctgcctgttactctgcactcattccgtcaaaatggctggtcctggccatcccctctataattttctcagtgacctcgaacgtccatttcgctggaatcagtggtgtcaattctgcaattgagcacgaaggttactctctcttggcacgacaggaagcttacactggatacatctctgttttggaaaacgagaatgacgggttccgcgttatgcgttgcgatcacagtctgctcggtggacagtggaccaagctggcaccaggctaccggcctgaggtggaagatcctatctatgcaatttttgccatgctcgaggctgtccgtctggttgagccggatcatggcgttccccgcgttgacgcagacagcaaggcgctggtcatgtaagaatcattcaaaacgcatcactcgcccggtttactgacaggaaacagtggtcttggaattggcacaacaccctctgcgctcatcaaacatggcattgaaactaccatcgtggagatcgatcctgtggtgcacaagttcgccactcagtatttcaaccttccgccaaaccacatccccgtcattgaagacgccgtaaaattcgtcaagaaagcagagtcctcccccaataaaccccagtacgactacatcgtccatgacgtattcaccggaggcgccgagcccgctgaactcttcacatacgagttcctctcaggcctctccgcgctcctcaaggaagacggtgccattgccattgtgagtcgcaccaatcaacaatccaagttaaccacatactaacgaataaacgccagaactacgccggtgacttgaccctctacccaaccggccttatcgtccgcaccatcacggccgtcttcccatcttgccgcatcttccgtgaagcgccatccggagaggacgaagataccgacttcaccaacatggttctgttctgcaagaagagctccaacaccccggttcaattccgtgaccctgtcccggcggacttcctgcgcagcaggtctcgtgaaagctatcttgttccaaagcacgaacttgacactgccatgttttccacttggcccaagggtggcagatctcttctgtgggcgaaggaggttggaagattgcacaagttccaggatcgcagtgctctcaagcattgggctattatgcggaaggttctgccggatgctgtatgggagaactggtaagtgttgaaaggaagtcgagcaaaatttgagatcggattactcttgatctcggttttatatttgctagctatgtcagaggattgtacaggaaaagtggttaccaaataatagtaaaatagactacgggaaaaaaaaaatcttagttctactaggaagcattctggcgctgtgttttaacagttataactccaacaaagagcgaatctactccgtacttgtctcgtcctccgtgttgctgggaagacatgtagactaacaatcacagacttcataactattggtatcattatctaacacctgccgaaaagccacgggacctccatccactgctagaataacagagcgactgcctccccttcacagtcaaaggcctccctccccatagccctttcatctccatatatcaaaccacctggcccagcgccaggggcgagtcccggcctctgtattatgtacgcacaaagaactaaaatacagtgagaaaagaatgaatcaagccgaggggcttccacggggactggacccaggcttcttgacgaggccagcgaagaagttcgccagggcttggttgtgcgctttctcatcattgccgccggtgcctgcatacgggctctctttcttcatggttcggctagcctcgcggtcctggggtaatatttagctatatcctgggttggggagggtgatgacgccgtgctggccgggtgcttacccgaagctttttcaacatatcatcggcgtccacttggattccgcccatgttgaactgtacagggccgatgtgatcgttgactttgccttcgtcggccatgggagacatctccagttggggggttggctggtttgcattctccttctcatccttggctttgagttcttccagtttctccacttgggttgcgaagaagtcctggaggtcggtggtctcgatttcgatcttggtcgtgttgccgtgagggttggctatgcctcgtttgggatcggtgatcgtctgttcgaacatcgtcaccgcacttgtaccttcttctgctagaccgttctcgctttgcgggttgtcgtctgcggattgatagattgactcgggagggtcctggatctcaattgaccacgctgtcgacactccctccatgtcaaatccttcccgaataatccggatcttaccccatgagtcccagttggctggcaccagaatcttgtctcggtcgatcacattatgttttaatgattctcttttcaatagagagtgtatgcccagagaagaatggatcaggccctgaagagagtttgcaaggaatggggtagtatagatgagcgatgcgccgtctgtcaggcggttagaaaaaagcccagaatagcgagacacagggtaataaagtccttacgcttcaggagaatagttctgaggaactggagaacgaaatcaaactgctcttcatgccatccgtggtccttctccagtttctcgatcttatccgcctgagaaagtcaagtcagcaaagcttcaccagcaattgatttctggaggatagtttacgtaccccttggcagacaacacacattgggattccgaggccttcatcccattcaccaggtcctaaaggtattgtaactggaccgcttgagtttgatatgccgcctgcagctgcagagctgggatcaattccccttttacgatcgcgccactccgtcatggtctcttccataacgaatttggtttcatcgtcaagcgaaacaagcacagaacgtagcagacgcgtccattcccttagccttcgaacccacgtccatgggtctgaccagtccatcaggatgacaaccagcgtttccgggacggacttaggggtcaggagtggtttgaggagaggcgcgaatgacggagacggctcggacaggaggtaggccgaaacgcgggccagagtatctgcacgagaagagcattagcatagctgaaactagtaaagagtgcatttcccatgtaccttctttatccgcatcgaggacatctcgatatgtgtatccaagcgcaaactgattggcgattggcggtgttttccctttacctttccgcttatcgtttgctaagctagggtctgcagacgtgtccgcggaaaaagtatctagaaattccctttggctgtccggcgtgccacctatcatcgagctattagcgacatgtccaagaatcgaagggcaataaggacgggcgggactgagatgctcggaggaaacaggtactaacctagcactagcaagttcttctcaggcaagcgcttgccgttggcaacagtatctaatagagaggaccaaatgttcttcttggagccatctttgctggttggccgactgctcgttccggccgctttcgacccgggattcggactggaggacatcgtgtctagtcccaccatgcctcaaagggcattcacccttccaaaatgtttgtctctaccgtagcacagcggaaatattgtgcgcgtggaaatgtggaggcggagggggagaaaggcgaagcagcgtcgcgggtcaggggaatcccgaggaagatggataaatgaaggcccagttgaaaacaaccctacttgcgaaagggtcttcgattacaactcacgaagaaaagaagagtggaaggtctttttctggcacatcgagcagggggctagtttgcattataaaggtgcgtctccgtaaacaattgattattacggttccgcgcgggctccacatttctttctctccaacttctgccacatcttggaactgctctctctcacacacttcccccaatgaattccattcgccaggtccaggcgctcaataagcgtgagcttgagcatgcgatgtaagtcgagctcatgtgaagtgcccaaaagctcttttcccccgctgacagtgttaccttttatagacccccagaggcatcatggcacgcagactaccgcgacacagcctatatctacatcggaggacttccatttgatctatccgaaggtgacattatcacgatattctcacagtatggagaaccggtgcatgtcaatctagtccgtgacaaggaaacaggcaagagcaagggatttgcctttctgaaatatgaggaccagcgcagcacagatcttgctgtggataacctcggtggtgcaactgtcatgggccgtttgcttcgagtagatcatgcgcgctacaagcggaaggatgacgaagaagagcaggacaatgttgccaggttgatgggggatccggttatcagcgaggacaagaaggacaaggatgacgaccggagaaggagagccgaaatagaagacaggcggccgatgctgaaggaagagaaggagctggaagaattgattcggaaccatgatgaggaagacccgatgaaagaattcctcatcgaggagaagaaagaagaagtcgctactgcaatccagttgtggaacagcaccaagaagtcgtctcgccgacgcgacgacagcagagagcggtcaagccgccaccaccggcgacaccgctcccgttctcctcgcgagcggagacatcgagacgatcgttctccagataggcaccgacgatctcgccataggtcatccgaaagaggggagaaatctagaagggaccggtcaccgaggaaatcgcgctcgcccgagtcccgaagacaccgaagtgatcgggataggcatgatcgccgccattgaaagatatatgagatatgataaagtcttctaaggttatctacggtgctacccatatttcttgccgagattctctcattgtgacctgcgtcaccctggcaaatcaaaagtttcccagtccagcaagtgatgcaatccctgcttggtgctggtgatgagctgtgctgcggacaaggtgttcgttattttgctgtgcgatatactacccttgttatgacagactggggaatctctgtcaaccgagatatctcttccagccatcccgcacacaatatctcttgccttcctcgccatctcgaatcacgaatttctcccagcgcccttcttttccggatccgattaccaacagagtgtggtcatcgcaccagcctatgaggcctttctggggccgaccatatggtgacccgatcggtggcacatgtggtgatcccaggttggcttgctcgccaatctcaaaatgtgcgttggcaaatgaataaacatcagagaagacacggggaagcaggggaattttgccaaggatcccccatttgtggctagatgtttcctcggatgccggtgatggcgactgactgcgacgagcgggttgttggtgggggatatcgaagatgtggagggtcgatttgtcagatgttactgccagtaaagtattggacggcgaaaaggaaattgagaatatcactgcgtggtcaacaccacggcgcaattctgccagtttcgtgcaatttcccgtagcgaatatacgaaccagagtcccctatataggcgtcaataatctacccctagataattgcagtgtaagagtactcacggcctcgctcgcagtcgccagcaagtttccatcgggacttagggccatagcccgcaacggggtgctatgtgcgggtataatactgatgttgccggtctccagctctatcatttggacctggcccggagaccggcctgggaaggccagcaacttgttatcgagacaggccagccccaaagggttgtcggaggtctcaaagaccgagagtttctggggagggttggagaatgcaaagacatggacactgttcaataaaacagcgacaatttttgatttggagagacgaacaccgaggacggaggtgcggaattcaagtgtgatggccgctttctgtttggcatcgtcccatataaccaactaagggtgtctgtgagtttgacatactcgcaaattgtgctggtaataatttcttaccttgttctgtggaaacttggggttcttaccacccccgacaatggccaagtagttcgactggccaagcatttccgccaccccaatgcctgcattgaaatcttaagtgcgaataagacagtcagggtaagttcttcaatatatttggacattatcaacttgacaataactcgcttacctcttaagaccttgagctcacaagggttggcattatatactgttcgggtcgttcatcagcctgagctccatagttcacgatataagctagcttcgtccaaggttctcctgacagctaagcaagcattccttaccacaaaatcccgtgtccaagcccactgagaagcagctgttatcatggttaaatgttgcagagagtgaatatggcccggtggactcatcgatagattggcgggtattcattgctgtatgttaacgaagcatgggaaaggatatgttggccaaatagatagatgtgggtagactctgtataagtagccccctgcccttaatagatattgaattaatgatctttttcaggttataatgcttcaaatgccttcacaggatgtctgggaatccccgagcttccttaatcgataagagcaatgcgggcaagatccacttcgacacctcaggcggtgaattaggtaatcatacggttgccagcgacgacccactttgctcaacccctgagttgatgttcgatgttggtggatgggaatgaaggcaatattgtacatggagaatatgaggaatacccgtataattgacaatatactacatttcccctttttcccctacatccagtaatccattgggacagatcaagagctttgtagaagtaaagtaacagactggagaagaagagctgtcccgtgattggccgcccatttgggaaagggggaaacacgaactgtctttcctccccccccctactctctccagactctcaggagagccaagtttcacacccttcttcttttattaattcctttggtcttccttttcttacatttctttaattttttaactcacaatgtcgtcagccctcaacgcggtatgtacatattttattgggagcttccttcctaaaaagtttcccaagctaattgcatgcccgtactcgttccgggtagatcaagattcgtcgcaagaagaatgtcaagaagggaatccaattctgtttgatggtgtgcggcgccagtggaacaggtatgtttcgaaacgaattacacaacttccggggactaatcgggtctcctttccacaggccgcacaacattcgtcaacactctctgcggcaagcaggttctggagggcaaggatgccgatgatgctgccaatgctcaccttgaggagggtgtccgtatcaagcccgtgactgtcggtcagttgaaatcgtcccccgcgcacggcgcttatctcaagctatcaatactgacaccgggatggcagagctcgagttggatgaggaaggaacccgcatctccctgaccatcgtcgatacccccggatttggtgaccagattgacaacgaggccaggcacgtacacacagttacccgacagatgttcatggactgacttttcggatagcttcggcgagattgtcggttaccttgagcgccaatacgatgatattcttgcagaggagtcgcgaattaagcgtaaccctcgattcagggataaccgagtgcatgtgctgctctacttcatcacacccaccggccacggtctacgtgaactcgatatcgaattgatgaagcgcctctctccccgagttaacgtcattcctgtcattggaaaggccgactcactcacccccgccgaattggccgagtccaagaagctgatcatggaggacattgaacactaccgcattcccgtctacaacttcccctacgacatcgaggaggatgatgaggacactgtggaggagaacgctgagctccgtggactgatgccctttgctatcgtcggttcggaagactttgttgagattgacaaccggaaagtgcgcgcgcgccagtacccatggggtgtcgtcgaggttgagaaccctcgtcactcggacttcttggctatccgtagcgctttgctccacagccacttggctgacctgaaggagatcactcacgacttcctctatgagaactaccgtactgagaagctcagcaagagcgttgatggtggttctgggtacgtttctcctggtgctagaaatttctgtgatcaatctgctaacgcatggagcagccctagctatgattctgctatgaaccccgaggatcttgccaaccagtccgtccgtctcaaggaggagcagctccgccgcgaggaggagaagctccgtgagattgaaatcaaggtacagcgtgagattgctgagaagcgacaggagctgttggctcgcgagagccagctccgagagatcgaggctcgcatgcagcgcgagcagcaaacccaggaaggagccaacggagaggcctagatataccctgtcgacgatacagctcattcagcggggcgccagttcgcaatgtgataccgtttgtgccagcatggactttttatggcactaacaagtcggcttttgtttatgggataatattgactgtttattcacgttaatagctttttttttcttctcttcttacctctgcggggatgggccacctcaacatagattacagcactccggtcacgaattgtgggtgcaatgcttctcatttccaatgggagactgaactatgtcgagttgggaattgtttttactggtttccggatccccggcctcgatacatctcgctcgcgttccccttctagcacatgttttccgccgtgtccaggtcctcctgtcttctttttccctttccatcacatctcagctaccaccgtcaaatgttgctgtgtcatttctatttcctcatctcctctgcttcctctcctgttcttgtccaaagtccgcagcgcagcaatattccctcttctcttgttttcgtttttgcgttcgtggctcctgtcttgttcattatctatcctttctcctcgcctgtcttcctagcccgatagtaattgaggacgaaaaagtactcgactagctcgctcgcttctgccattttttctagttctggtaacgtagttggttaccgtgtactatctgcaccaaccttcttgatttgcggagatcaaagtattcatgaatatacctagcttgaacatattagttatgttgggcttgctcgaccttgtgtttagggaacgaagaggtccaagtctagggcttcgccagcaaggacgattacatgccgttcaattcacacttccttgtttattgggttaaaattcgtacgtatactcgctaggtatatatttctagttgcatatggaccaatcatccagctatgaacgaacatgaagagatatagtattgagacaatatattgttgctccatgccatgttatatattctgcttgtatgaaggaatgtaaaaacaccatgagagaacatcgagtatccacattaactaagcttgagtctactgcaatctcatctgaaatgcaacggtgccattcacatcaatggaaattgttaagtataacaaagatgcctcgaactcaaaacgatacaggtagaacgaagacgtttcgagaatatggtcatgtggaaggagacagagccggagatagaaggagtaaacaaaggtaaaagttttttaaaaaagaagagaaaagggagcaaatgctgtccgcaagaagttaaaaaaagaaagagaaacgcagccaaaagcaagaaagcagacacgcaagaagtggtatttgcgctccattgtacattgcgtagaaaagacgggaagaacccccgatttgttgtaattggtgtcgaggaaagggagggattggtgattgccaagtagatgtggatggttggctgaactgttgtagagacaacatagtacatacatccacgactttgcgagcgtggtgggatgacacatccagtgaaggattaatctcatggagaattttaggaaaagaagtccctaatgttccccgggaagagagaagcgggtgacagcgccaaagcggcgacgtcaagcaggtttcgttgtggcatgcacccgcgtcggacattatacagcagctggctgcggcttattggtccagaaatctaaactggcaacagtgtcatagccccggtcatcttcataggcatagataatctacgaaacccagttagcgtttgatcagtgatagaatcaccccagagaaacctccgagaagagaaaacctggaatagcttacctcgcgcgtggaactgtgcaacatgcgaatgttcttgccggtcataaggtgcgtcaattcgcttgtttcaacgtgtcgaatttcaacaaaattgggttcgaatgccaggatataaggataggacagcgcgaatgagttggggttgccctcccaggcgatcctccagtccggacgggctcgccacccgttgcggttgacgaagaatgagaaatcactatagttgagtaggaactcgccgttcatacgctcaatatgaatgggtttcacattctcctttcgtgccacgaaatcaagagacgtgtcggcctggtcaaggagagactgcgtctccgttgtttctagactgaccacttcaaagccacgtgcacaaccaacgcacagagtagaacgcaggaagtgaatggaagaagactcggcagggatatagtattcctgggtgaaagtgttagcatgaattgaactacaaatatgcaacagagaatacgaaccttgaatggcttgagggtatcctggccgccctggaacattttgctgacagcggacttcttctttccctttgccagattgtccatcggctcgtagaccttgattgtacttgatagtgctgatgttttgactgaacaaacaagatggcgaccgagaccaatgcctgctttgaaaaagttggcatgtccttgaattttcttgggccgctttgccatgctgttttggccctcaacgtaatcaagagcgtccataggataagaagaaagtgttttgtttgctagaaccaacagcagctggtactcttctagagtgtcgatttgcgtgacctgggtagcctctagaacctttcttggtttcgctgttttgtctttgggccagcgttcagagacaaatataccattatcagtcccgtaaactaatttgcgacctccatctggtagcagttagcgagagactcgaggtgaacaagaaattttccacttaccgatcggaacaaggcaattgattcggttgaccgctgcgaagaagccctcgctcaggatcgtcttgttgtagaaattgctgtttcgctcccacagtttctgttgttgttgctctaccgcttcgataaacttccgccgtgtggcggcgcttgtggcataaagagtctgctcataaccacctttgccaagatgtctgaacgtgatcggcagtccgccatctttggcaggagggggattattgatgacagccttattcgacaggagactggatgaaggtcttttggcaatacccagccgtgggataacctcttccatctgcgcgataactaacagttccaaaggaatgggtttcctataaactcgagattcctcccgtttattcaccgttttgacgcgaacgagcaggacggcatgatcgaagagatacgcagtaacatccgagctgtcggctgtggtcttcttgaatgacatcttcatgagcatttgtcgattttcttctgtaagcttcaaatcgacatagtccgcagagttgaacttcagcgcagcgttcagctggaccaagttgaaatggttctccgcttttccactttcggcattgacgcgcgaaaggaagtccttaatcagcttgatggccttcggaatatcttctttgtcggggttgccatccgcactgttcttgtaaacaccttcaagcaaaagcgggtaccttgcaagacgagttgtaggcttcgtcaagtaaccgttcagttccaacttccgagattccttgagacgttccgtgtcttcgacgaatttggcgaaggctgggtttgatgctttttccttttcaaactcgtactttccataaagctggttggcaccatatttgatgaaggggtcgaaattagggacatgttgacagaagatgtcgccaatggtgtgaacgacttgactctccttttgtcgagcattcagggcttcacacagagcgctgttgaccttgaggacctctaagcagttgccaaacacagttcggatgaacttctcacgccggtgttccggaattggggagtgggtggtggttccagcagcgcgcaatggtcgcatccagaaatcccgcaaatattctaagtccttgacgaaatcacgctccgtgtacatgacctcgaagataatctcctgccgtttcttctcgtgatcatcaacagagtccgagatctccttgggcactgtgctaatccacagcttttggttatcattgtcgtcatcgtcatcggggggcagggcagtcttggattccgatgttcccagcaccggctcaggtttcagattcaacctggcttgctgctcgagtcgtcgcggacaagcgatagaatagcagagagtgtcccggttgcaagtgggagaataacattcagtcaggagagtgaacactccattaacctcgattgtcgacttgtcttctcccattgtttccttgaactgatagacctctccgggtgcatctcgaagacggtggtcatatgtgacatcgtggaagaacttctgagcatccagcgcacggccaagcaaaagagcgaggttgcggtcgttggttctgatgatggaggcgatcaagtccaccgagtcagtgcccgagaatgcgttctgataagaaagaccgttcttttgtcgttcgccgagtgaaatcttttccctgaaaacctcagccacaagagaaagcatagcaggatagaccaccggaactttccgttgtgaatccctagaaacaagggtagcttttccggaggagccctgtgtgccctgtgtggcttggctttgaacgctcatcgtccgatcgggcgcaacagtggatgccatagacatagtccgagatctttgcgatgcatcgcttggctgacgagatgcgacgaactcgtcgggaccgggctgcatcattgagtcgtaccttactggaatctgctggtcgtgacttgacggaggtctgcggtatgggatcgaccttccgctgttcatgatatgcggatcccgatccgatgaccaagaagtcatagacatagctcgctcgttcgcatgcttttctgggacaggacgtccgagctgcgtgacctgagtcccagcatgatactgttcacggcgagaggcagtggcagaggtgtggttgaagttgcttggcggggtctggtaaggtggcccgcttagtttcgccattgatcttgaccgggtcgaatcggaattcagcgcaggaggcggcataggacgattgaaatccctaggatctgggtattgcggagcagggcttggtcttgactcgaggcgttgaggtcgagggtaggcagcaaagcgttgttgggtgtttggattgtgtcgaggaagctgatgtgaagacattgtcgccgatgctcctggattgtaggcctgatactgtccagacggtgggggtggaggatatccgtttggtggtgccgatggcggcccatgtccatttggcatttgccgtgttggcggcggcggcggtctctgaaattgggggtgtacgacatgcgatgacatggtatgagcgcgaccctgcgagaactgcggagtctgcgaattcattgtatgagagcgtcctgcgggtggtgcgcctccaaagatatcagaatacgctgcatcccgttgcgtggacgaggcgggtccgtgaggccggtaattccggctacgttgaccccccaaatccgccatttttcacaaattgtcagcgatcccaagacgagtatcggttggtttaatcagatatgcgaggtatatgtatgccggggtgcgaacaaggcgaaaggggtatccgggtcgatcgtggagagcgttcagggcgtcgcaatggtctgttcaagatcgtagacaacgggataaacaatagaggtaaggtgagataaaaaaaaaagccccgcaggcaatggcctcggaagaaataatagattgcctcaaagcactgatgggactcaatattccataactcccctcagttatggggaatctaaaggcaatatcaaagcggtattaatggaaaagcgccaggagccgtgagcgcaactaagtcaaggctcctttcaatttcatgccctcagcatcctccaagatctgaggtgagtagtgaaaaaggtatagttgttgaaggtgggggtggtagttgttgaaaatgcagtaaactggggggggggggagggacccaggagaacgaggatggcgaaggtgacggcgaggccggtatagtaatttcaatacaaagcctcctaatctgcccggtgatatagcgttgagggtcgagatcgggaatacaagaggtacggtatcgtcaccgcccagacaatggcgaggactacggcggccgaagtgaccatgtggaacaccccaaagccccgaatccccaatcaacaggaacttatccctgctcttgatcttgtatcaaacagctctcattttcattcttgtatttctttgcaagtttagacttgctctaacatcaccatggcagacagtgagcttgcgcccaagttcgctccgttcttctccttcgtgagttcaagccccgagaacattgaggttgataaactaacaggcttcctataactaggctggcattgccgctgcagtgagttgattatatcttcgttccgatttaactgtatactaacagttccctatagatgatcttcgggtgtacgtgaaatacctcgcgtggatggagctagctctctaggttctaggtattcggacaacagcttacaatctcacagcggcaggagcagcttatggcacagcaaaatctggcattggaattgcaggtgtgggaacttatagggccgaccttattatgaaggtaagaaacatttacccaggttcactcgtttcgtggacaagacggtagctaactgagttcataactgcagtccctcatccccgttgttatgtccggtatcattgcagtctacggtctcgttatcgccgtgctcattgcgcaagcggtgggcccaacaaccaacatgagcttgtacacgtacgtttcaagaattcggtgggtgtggaacttgacacaagctgacactgcacagaggtttcatgcatcttgccgctggaatgtcagttggtcttacgggtgtggctgctggttatacaatcggagttgtgggtgatgcagtaaggaccctatatgcgcaaggtgaaaggactattgaagccctaacagctactctagggtgttcgagcatacatgcagcagtctcgggtctatgttggaatgattctcatcctgatttttggcgaagttcttgggctttatgggtatgtttctgagtccaggttctttagattactcttactaacggtggatagcttgattgtcggtttgatcctaaactcaaagtcttgagcagcgagtgaattacatgcagcaactcattgagcaacactttctcgtccgctaccggccatcctgagctcgaactacaccatctaatgtgtaccaaagacgtaactaggacagataatggccacgggactggatcgagatatggacctgatgtctgaatcgaatacattcttaagttccagtgtataattaaaagatcttatatagaatcgggtcgaatcaaagctacgagcttagtccggtttatcatcgtagtttcttcccgtttagccccgcccccaatagcaaatacgtcagaggcagaacttacattcttacaactctttgccccgcgattttttctctcaaaccccagattctttcaaaccctcgaacctcaatgttctttatcatctgaaacgtggaatccacctgtgttgccgattggtggcgcgctaacggggtctccatacactttttttttacccttttaccgcgacatgatcttggaccattctaatggcaaccggagcagtgcaacattcgccaaatgaggcgccaggaaccatggtcttctccaagataaatggcaacctgcaccacagggaaaagcaactcgtcgagtccctccgccattctccgcgatcctcgaaccctttcctcatcaccgagcgccaggacgagaagcaactgtgcatttcctcgaggagtctgcatgtgaacgattttgcgctcgtcaagactcttggaaccggtcagcgcgtggcctaacccataatttctcaagtgtcgcatctgacagtttatacttctcatcgtataggcactttcgctcgggtgtggctcgcaaggttaaaagaccaaaaggacaaggacaaagtctatgcgttgaaaattcttcgaaaggcggacggtaagcgccactttgtttagcgttgcgcgtggcgagggataactcgtgctgattgcgactgaaagtgatcaaactcaagcaagtggaacatgtgcgcaacgagcgaaaggccctcgcagcggtggttgaccaccctttcatcaccacattgatcgcatcattctcggatgagaagtgcctctacatgctggtatggcaacttttcttttgcaactcggaatagggatgatcatagggtgctgaccaattgttagctggactattgtcctggaggtgaaatattcacgtatctacgacgccaacgacgctttagcgaagaagtctcgacattctatgcggccgaaataacaatgacaatcgagttcctacacgacgtccacggagtcgcctaccgagatctcaaaccggagaatatcctgttggacgccgacggtcaccttaagcttgttgacttcggctttgcgaagcaagtcgataaccgcgagacgtacacattatgcggcacgccggaatacctagctccagaggtcattcaaaacagcggacatggacttgcagtggactggtgggctcttggaatcttgatttacgaattcttgatcggacagcctcctttctgggatcagaaccctatgcgcatctacgagcagatcatcgaaggccgtctacgcttcccgcccaatatgccggctgcagcacagaacattgtctccttactctgcaaaacaaatccgacggagcgactgggccacatctctggtggctcgactcgagtcaagtcccatcctttctttcaagatgtcatttgggacgatttgttttatcgccgggtgaaagggcctataattccccgcctatcacaccccgcggacacgggtaattttgaagaatacccggatccccccgacctcagaaacacgaacatctacacggaggatctgaagaagaagtacgagccgttattcagtgacttctgaaaggttctttcgccattacagcccatcaagctctcaccggaccttcatttctccggcattctcagatgacggccatcactctctaaccccacgggaacccccacgcacacctccccggtgagcgaatgctcctccacgcaggggccgcacgcctgatcattcgcgatcattagcggtcatccgcgccgatcttagctttctgttttcagatgagatcccatgacagcccctggcatgtatgtctggtgaatcggaggatatcacacacctcgccatgctattcagtcggtgtcgccgccataacttgaccttcccacatatccacacacacgtggacaacagtatggagaccatcccgggcagtattgttttttttaaccccctttttttttacatacactccccttcacacaccttgtgctgatcatggtcgtggacattgattacctggaatccatactcttccccgacctcaacaacctcacaaggtttctaggcgcaatcctgtgtacgggaccgttttaatgccatcttcttttgactctcctttcgtcgtaaagtgataacattacttacatagtcatgggtagtggatcgcgaagttacatagatggctgcttttattattccggattttcaatatcatctactatagcatgtagatattttcatcttggacatatggtcttatagttagcacagatttcgtgtcatatcaagactcattcaatacattgtccacaaccatctcatccctttcacaggccggatgaaaatcggcaacagaaagctagcactcgattagaagatgcatccgggaagagaacagttctagttgggttgtctagataggatggacacattcacataaatctgataatcgcagcgtttattgatagaagctaagaatcacctctttctattgtcatggagaacatctatctccctgttcagagagacttgagtatagcagaaatatatacatagatccttccggtggcaacctgatgtggtgagccttgaggtatgcttcaacctcatcacacctcaccagtctatctagcccgaaggatgggacctgaaactttgacatattatgtacacattcaacccaattggattcttcttagatcgccttgcacaatcggccatcctcactctcggtccactcgtcagacccgacagcggttctggcgtagaagatatcgttgggatcatacttggccttgatctggcgcaaggtatcatagttggcaccatagaagacctgcttgaagttgggctgttggaagtcaccctgtcaaaacagtaagcatgtgtacacaataatgaaaggaattcgagcccactagagctagatatcagtttacatacctcgttcatataagcaccggactggggagaaagcgcagtcagcttaggaatgaaatcctcagtcatttggcgctggcgctccaccatgagagcgtcattatcccactcccatggggtcgtcagagtagtatcgatcagggtgtcgcgccaagcagggaggactgcattgtggacatcaccagacaccttgtgggagacgttcaagccgacaccgatgaaggtgccgcccgcctcggtgatctcacggtaggcggtcagcagggcgtggttgttgttctcaacgaccgatctcgggactagccagcctccatactgggcagtggaaacctggatggcgccctgcatatccttgaactggctgtagtagctgttgtactggttggaaaccatgttgtagttgatgccgagcgtgtcgagcttgtcagtgaagggcttgagaagcgccaccaagtccgcgacagggatgttaggaccggtgatgggggcaatagagaagctggtgttagtgaagtaccaaacgctcatggcacccgcgtcgacgatagcgggcaggttggcgtggaaggtctcgatggaatcgtagaaggtatcttgggagagaccctcatttgtgtaggtcaggttcagaccagagacaggagttccggggtgtgccttcgcggtcaaggaccagacgataccgtaagtgcccgcaccaccaccgctaagagcccagaagagatcggagtattcattgtcgcgggtagcagtgatgaagttgccttggccgtcaatgacctcccatttcaggacttggtcggcggccagaccatagcgggaggcaagtgcggagtgaccacctccttgggtgtagccaccggcaagaccgacgctgggacattcaccgccaacgacctggtagccagtctgttcggcgatctcgtaggcttcgaagccctggattccagctcccatggtaatggcctttccggagtagtgctcatcattgtaggagtcgatggagagatccttcaggtggtgagtccagattgcaagggctccggcgccagtggatcggccattgtagtcatggccggtgttacggatgacaagacggatgttgtgttccgttgcgaatttcaccgtgttggagatctgagccgggctggtgacatccacgctgtagcgcacatagttgcccagtgtgcagggctttgagacagggtggaatggatcgcaaacgccctcagcaaagaacggcgccataatcgaggaagacgattcatagctgtcagaatatagtcagtactgaccctttcgtgttattctacatgcaaagcgacatactgttgctcaggaaatagccacccgtccttcaagacggcacaggcctcagcattgtagttcgggtcatggcaaggggtcccaagagggacagttttcactagtcggccatcgatcgtctcgttaaattgagaccattcagcacttgtgggccagcattcagcatcatcgggcagacatcggcaagccgatgaggctggctcaggtagaattgccaacagcgaagcaaggaaggatgcacggaaaaacatctcggattggcttcatgcaaatgtatcaggtttcaggttcttttaaatgtgtattccttatgaaagctcaggggcaattcgcttacaatatagaagaatccacagtatgcccgcaatatgagttgcagctaatccaccttgctagccctggaaaccaacctcggaatggagattgttccgggacttattggaagaatcgaccactcatgggggttttccccaccattcagcctttggaggttggaacctgcgaactttgtacaattttcaggaaactttaaaatgagacattccatggtttcatggtccgcgctggcccgatcaaccttccaaggttgtcgaagtattttcccgcatagtgtggctttctgctttggacgttctgaaggatattatattctaagacatgttctaaagcatgttctaaaagatgatatttgcttatttatttatttgtttactattattattcatcattatttattatttattatttttttctaaatcatccaggttatataatggataatgcacatgttctagtggcttgctcatagctagctaagcaatgacacaaaaaccaggaaaagcaaattattggcaaatcctaatttccaaatccatattgttttccatggtttgtgaatctagtttgttgcgacttaattgcactataagcccccaccgacccacccacctgatgaaatcatgccctcgtgcacgatgatcggtggactctgtaatgattatgaataagaatgccacatccccttgcagaggctgccaatttcccttactcgtgataatgatcggatcatgggctgggtatacaatctccacgagaccgatccaaacagcgacattccgcgagtgatcggggtctgtttggtgtgctcagttctagcctttctggccgtatgtctgcggttctatgtccgaataagcagcaagcgctctccatggattgacgactattctgcactggtggcctcggtattaacgttagcatacgccggaatcgccgtggctcgtgagtcaattcattgattaatgttaactgcctaactgaccgaatggttatttcagagacacggtggggccaaggactcagtgcagcctacttcccaaaggagaatgttattccttttagcaaggtgcgcattgcaagaccaacattgttcgaactcgagcctgactcttaactttgctctatagatccaatacgccggcggcccggtctactgtctcgctgtcctcggctttaaggtcgccttgttgacctcctatctgcgcatcgcggggattatcgagcgatatcgcaaaatcatatttgccgccatcgtcgtgtgtgtcattaatcaattgatcttcacctttatcatatcaatctcctgcacaccggtcagctcctcaacagtgcgcaccaattgaagagaacgggttatctgacattaaacaggtcgcaaaacaatgggatagttctctcgagggacattgcatccataccataccattctactttgcactgggaggcacaagcatcgcgttagacctgattatcatagcactacctctgccagttctgtggaaactccagctccgcctcaaacaaaaagtcctcctggccggtctgtttgctctcggcttcttcgtgaccgtgatccaggtcatccgtatcttcaccgtcaaagccctggaaacctacaccgatagcaagaatattgtgatctggtcttgtgtggagaccagcctgggcgtgagttaatttttgacatctcttcaagtttaagcaagactaacgaaaatgtgcaggttgtcatcgcctgcatccctacctacgggcctctgttcaagtccttcgcttccaccgtcacttcataccgaaaccgcgacacttcacgtacttatgcgcttagctctgttcgccaaggcacggggacggggtcggcgattgcacgcaaaaagagcaatttcgagcctatatatgagtccgaagggccgccggttactgatattcgatccggagcgccgacgaatgatggggatagcgaggagcatatattgtcggaagcggagaacatgaaagtatatgtgacttcggaatttacggttaagcctggcgtcgcccattgatttggcgtcgggccttggagactgtgacttttgaacgatgagaaatggttgtacatataatattcgataccaaacacgtgtacgagggtttttacgaaccatcatgataaccggcctaatcgggatgccgcctacactaccttactcctctaccttcccccgactcatacctacatgggtatgtagtattagttgacacagtgagcgggagaccgcttgatctcggcactgtgaggatgtccattttctgtgttggacattcggcgtcgcgtcggtgcacccatccatcaataacaccgacgatgacaaattcaatctggtccgaatgttttgagcgagaggcctaaagcttgagacattggtgactttataccctgtcgttctcttacctatataccccagtcgctctaacctttaccccagcggtgcaactacccttcccacttcggtatattaaattcacatgttgtttgcctctttgagcttccaaagaaggaaaacagaaaaattaaaatggcagcaatggttatgcgagtattcacggcattcggcccccgaaagttgagaagaagaatgatgctatccgctttggtatcctcgaggctgcccagattgcgtgagccgcattcaatgcttgaccttagaacccatctgaccttgttattcaatagacctcttacctagatcacactcgccctctcacacccagaggttattgtacaagcagtcgctgctagagataatgctcgtacctcagcatccaccaaaaagcacaacatcgcggatgttcgcacatcctatgacgaaatcttcgaggaccccaagatagatgcagtctttattcctttgcctaatagcctacacttcgagtgggctgtgcgcgccattcgcggtggcaagcacgttcttgtagaaaagccatcgacctctaacgctaccgaagccgggattcccttcaacctacctgaactgttacagccaaatgcctcgtaaaaaaaactgctcgaggcattccacaaccggtttcatcttgtagtgcagaagttccggtcctttatcacccccgctgatgtcgtctacgtccacacagactctatgattccgtggttaatgcttgatgaggataacattgggttcaactacaaactcgctggcggaagtataatgatgctaagcacatacaactttggcattatccgcatgattttcgacgataatcctgtggagtgtctaacctgatgaaaatgatagacatggcgtatgaggagagcgggctggggttacggccaacatgtctgttccggtaatcgagctgctttggaagaaggctacgtcttcgtgttatgattttcgttattgtttggcttgcatatatctctttaggtatatttcttttatagatcttctcacccttaatcagtgctgtagctagaaggataagaagtagctgtcataacctgcatgtcacatactttgatatctggtggagatggcagaggaccaggtagttttacctgtgaactactcggattaggcatgcactgtcgcaacatagtcatatgtaatggtttttctaggctcatataatgtacccggaagccaatagcaaaacctccatgcgtatgcactgggaaatttccaaaaacgtcgcttttggctatcgaaacaatgagatcgaaatctataagcagctagtgtacgtagctagtagcaaaccatttaccaagcaaaaaaaggtaaaagaacagtgtatgtaacaatgaaaacaaagtggggaatcatatgaacaggtatcatgaaacatggatcgggtttaaagcttgcgcctgggttcagtcatattcaaggcaccgatgatgacagttcgatgccggagattttgagagtttgggagtctgcgacgggagcagaaacaatcgggagatctagaggggaggtgtgggtgatgaaatcggagcaaatattgagatgaactgcaggcaacggcctgcaataggtctctaatcttgtacagtgtacagtgttggaatcaaatgagattaagattggggcattttcacagcgatgggtctgttttccatgtgcctgaaatcgaaatgttagtactatgtccacatgagaccaaacgaatgtgccatagatagagacatacctccgaaattgtgcttcacaaaagccatgggatcgtctggatcccctgcacccatttgccccacgccggggctgaagctggtaatgggtagaacaaccacatccccaaccttgcggtgtgtggtctggtggctgaagtcctcgtatgtaatgttcttatcacccggctggatattgaagtatgccgggttgttgaagtagcggaagacagaatctgtccaggccccaggccccgtgaactccataatagtcttatccatcttgccaaccttgagaatgccggcccttttcattcgcagagcatgctcggtgacataagccaccatatcacggagaatcggatgcccaggtttagacaccaaggtccactggcagaactgaagacggcgcgaataccagtcatgccagtcatcgcgatcaggatcagcctcaattccaacaatgagtccgatagttgatcgatcaagttcctcggggagccacgtgtgcgcgggcctgagtgccaacgtgtcgatatcgctgtatattcccccgcgcgctaggagtaccaagtaccggaagaaatccgccttcatgaccgcgagcggcagtgaatcatatgcctcgaatacttccggaactgacccatatagatacttgatcaggtgttgctgtgtctcgtcggggatgacttcatgcgtgaatcccgggtgcatctctgtccagctggcctccagaccgcggaggtcttcgtcaaaccagaacgaccctgggtcgtatttccatgtttgccagatgtatgcggggaatttgttttcgattccataggggaattgataccggagacgttcgcgaaggggtgctgtcggtgatgcgccgaggggtaattgagctcgaccttgcggtggtgttttccgtgctaagtttgatgtcacttcatcctcctcttgtgatatcttcttcaccggtctgtacccaggtgccccaggaacttcgggatctcggaacgagcggaggatgagaacaaatgtgaccacgcagagcagggaaagcagcaccttgcgcggagtgatcatgacaggcgaacgagccagtgcagtcggaaaataattcgctggtcatgcgacagccgtagattggctgaaaggtaggagtcaaggtctttgtgcttttgtgtcccgtgatccgcaaactcggggagttcgattagttttggtatgggattcgttcggcgagtgtgagagtcgagcgattgcagatcctaggctaaagaaattaagagggtgacatatcgatatgcggaaatcttggatgtgaccttgatggtcgaagatacgtcaacccggaatcagtcaggataggaggcgtcaaaaccccaatgagaattgtcggtcactagtaccacagaacaggagaaattgagtcaaaaggcagaccaccctgtctggcagcaagtactttatcgccttgctggccagtttcgctagacatcgactggaataaaaggattgcgtattccggaagcagcttgtacgctaggtggagccactcacgtggtcttaggcgaaatgtaacttaaaagaaactacctaggtacctccatatatgtatgtaggtctgacctcttttgatattgtctattcttcgtttgttctttgttctgtattttgtgtgttcatttttcattctttcggtatactggcattgctgccatataaaccacttggttgcatcagagcaccccacatgaggtgctcctttcgtatccagaatgggtgatgatcatcccgagataaatagttagttaactagttattactcagttagttagttacaacttaggcctgacactctcaaccactcttaatccggatagaatgatagagctatatgctcaaatgagttgatctagggccaaacattgagggtggtttccgctgacccgctgcaaccttagaagctcggacagtgatataagcttcgcttggcttgggaatgaatatagaactaacatcatcgccaaggaaattggctcaggttatatattgcggtattgagtgtatacaacaggactgtacatatattcattagacaccattcttgcttcctcttgctactataaacggcggtattagcagttcttttcctttccaacaggctaggactagctctgctacattaccaggagctcagatctgacttttaaagtacctatttcaaagaggcgtggacttttcattgcaagacaacgtgattcctataataagcaaaccaaaacaagaccaaaacaagaccaaaacaagaccaaaacaagaccaaaacaaaggaatatcacttattcgctcctccccaacgcataagagcacacaaattgagaaccacctgtctcctattggatacactgctcaggtcgtaccagggggtggccaccacagtaatgcacgggcttggcgagggtgaaccaaagtcccgaagatactcttccgtaatgttgaattggagaaagcaaatgtagtgctgcgtagcgtggatgactataacatcatcaccgctcttggaatcagaaatcctagccagcaaagcctcgcatgtcatctgagctagggatctgtctgagatggtcggtttaccatcctcaagcgcatggaatctcttggcttccaaaatcgctacacgatcgtttgtgagtataaaattgtcctcgtctcggacacgtaggcaaagacctccgtcatcagtggccttgatcggcttgcctatagactgtactatgttggtggctcgtaacttgagatcccgaaattccacaacatccgacatatcattgcagtcttggggtgccccaaaatacaggacatgccgaatggcgcatgatacgaggcgcaaagtgtcatcttcgaccgtagctcggagtttctgttccgcaccgtcgatgtgaccagttgatgatgcactatgagagctcgcagcatgtggactgctagaagcgacttgcatttccccagagtggacgaatgctgggttttgattggtttttctttcacgcgccggtcttccactggttctagcgtcgttgtcaccgtcagaatcgatatccattggaaaatccgaatccgaatattccattccggaatggctcccatcatccgaattgctggcatcaattgattgctgtgtcctctggaagtcacggttgcccttgaatgctgccaaggctgcccacgtctgagcgagcgatatgctatagccaaaatttcgcacaaggctatgctcgctcttctcgaaatgcagatgatcggggccatccacgaatttcacaatctcaaccgggcccatcgcgtcggaagattctgagtggggggacaaaattggaagaatctgttgccttgcttctcgtactacaacgcggcaggcaagcaggtgatcaaacccccatccacttgcggaagtcatcgatagctgggaaatatgtttcacatacgagtcagtgaactgactggcggttgtgaaacggttgaaataatggccgggcatgttgaagatcaaatttgaaaaggagggaagaattgtgatgaaaagaacacatcctcgcagatactcgagtagtcagtaccttttatactacctcttgggcaaatattcgccttgccgccaggtgaccatgaaaagcatagttgttggttgtgccaacataacggtcgggccccttgttgcgaaaccactggcttcgagtacagcatgagatccaatcctagtctgttgggaattaatgggcggttaactcacgaaccaaccacatacccgtggatatctatgaattgcatgcacctccaggccaagcggcttagagacgccagcaaatccgggcccaggagagtatatgatacatgatttcttagacctctttgatccttattctaggagtatttacttacttatataattgctttaagcacagagtattaaacagcctcttgctatatctctcgcgtaccattatgggtgttgccattatgtccacagcatgggcagcactaatgcaccacctacctaggtgggtatatatatccaactcggtataaacccatacaatctaggttggaggtagtaagtagtttctaacagctctgatgggcgagagcgctttccctaagcgccgccctcacaccaggccagccatgtgatgaacacaccgttataatggtagccaaccacactcgaacatttagcgccctcacttcagtagacgctttcaggaatctaatctatgtccgacttgtggagtattcgagtattcgagtatcattgctattaataagtccccaagcaccaaaactgcaagcccattgacgttgggtaaaatcacgcgagtattcggggttcctactttcgggcgtaacctacccgtgtttgtattgactgaacataataaactagctgaaacgcctccttagatctgcattcttgctagttcaaaggggagataccaatacttttcactatgtaaaccggaattcctgtagttgtggcagaaagcatggcagaatccagcgtcgcacccgattaagaaggcggtactagagtttcaggtcagattaagatttggggtgtcaatataccaatcccttgtatattccttccctcagcctacgcagtgatacttacaattatcttcagtatgtcatctaatggtgtgatttcacttgctgagctcatgaaccatcaccgtgatctcctagttcagccgatctgctggacttctcgacatctggagatgttgggatgtcggtttgaacactttgaccatgtgccaactccaacagacgacatcaatcctgatgcaaatacatggcgaccaatttataatgacaatgagcttgaaaaacggcccgacctgctttatgaggaagattttgcagaaggtcacttttcgttgtgcccgcatgtctatttcggacgtctcgtacgtccgttgctcaaccgaaaatggtgcgcaatacaggctattccttgcaatacattggtccatccaaccatgactgacttgttgcttgcagtgaaacaccatatttcttttttgcaaataagaggattcatcgacctcaatacagcgtattctatcgctctcgtaaacgcagccagccagctgacaaggcaccgcggccaatcatcggatatatgcactatcgtggtgttgaaaagtatcgccaagagatgtttccattttctgatcctccggaaggttattgtaaccgtcccggggggcaaattcagctaaaacgagtagcccaaatcacgccaaagaattggagtgaggatccatatctgctgtgtgttctgctttcccttgcacagctccaggaataccatcgcagagagtggcacccgcccattcacgtagtaagtgatctgctcatcaccgctgctttcctttttttggacgcctagcttattcattcaagtcgcgtctgtttttaacacacggaccgggagaggagtttttccatatttttgaagctcacatcacctccgagcttcttgaaatgctcgacaacccaactaccgctacaaagcacatagactggccgatcatcaggcacataagggtcccatattatcccctcgaagatctcagagaacgaattcagactgagattgcccgggatcaaccacctggcacgtttgacatttcagatccagtccatcgaatcttactcccaggaggcagaagagattactcggaagacgctgatacaatccacatccaaagaagaaaagaagttaaaaaaaagaccaaaagtaaagtcaaaaaaacgagtcgttcgtcgctctgagacgggatcttggtgaaaatgcccaaacgaggatcatgacaggttgtctggcgtctgctatccgactacaccaaaccctcgacggcttcacacttccttaccatcgaatggtgaccctacgcccaggatcccactgtcctgtttgcgatctctgaggtacactgctatgataggcattacacaccacggaaatagaatttttaaccgtactggaggctgggggtcagatggtggttaaggggtaaagggcacggaatgggtctggtatttctcagcttcctacaatcgattcgaccatcctacgaagtacatttcgattgggacaacttcatggtggaaagattgtgtccttgaatacgacatgaagcaacacacaataagcgtgaataaccaagctagccaagtgttgtgctcaaatggcggagaaaatgcagcaggaataacgtgaatactgttgaagctggttgaatctattatcttgagtattactcaacagcgaaagttgtgttctaagagccagacgaggagaatgagggctggccaaaacataaatatgtacacttaaatcatgaccatgttatactgattaaaggtattaaacatagctaaaaccgagtactgggtgaagtataaaggttctattaggcaagtcccgacctaggggaggtttttcttaggcggaggtttactatgggctagccattcgccccaaattctctgatgttcgcatccatggacaacagtgccagtctctcaatgaatgtatgcctgataaagcaagcttattctcaggacagctggagtgtatatatagcctggagacgactaatgcgtctgatttccaacgattattcaaatcactcgtactctcccgctatacacagagtcctttctgtccgataaaagttgcaataaccttggaatgcctgccgtatgttgtacattgtatatacataatagtacttcaacgctcttgtctccgccaatcaccgatgtcggtgatgacgcgactctttagtgcctgaggtatcaacatatattccccgatacctttcaaacggggaagctttctttcctgactcacacagattctaaactcttataatgcagtcatttcgaggtgccgctcgagctgcttcacgcataatccgaatccagccatggcgacaaggcaactctctcgtgaaccccgcggggccacatcggactttatcgacgcaatggaagcccacgcgcccattgcatactgtatcgccgcgaaagtcagcgtcggtcgccgcggagtcaactgatagagactcgtccaatcctgccatgtcattcccatgtcttgatgctcaagaagcaaagtcagcgcagctctccgctcggtcgctgcaatccggccccgaaccttcatacacaaccgggcgacacgaatcataccactgtgaacaaccacttttactcgactggggtggtgtgctaccggaattcgatatcgcttacgaaacctgggggcaattgaacagcgacaaaagtaatgccatcctcctgcataccggcttatccgcctcaagccacgcccatagcacagcgtccaacccaaagcccgggtggtgggagaagttcattggccccggtttgccactggacaccgataaatatcacatcatttgcaccaatgtgctcggaggatgctacggcagtacaggcccctcttccctcgatccgtccgacggaaaacgatacgcaacccgtttcccgatcctgactttagacgacatggtgcgtgctcaattccggcttctcgacggtctgggaatcaagaaactggctgcctctgtcggatccagcatgggcggtatgcagagtctcgcagcaggcgtcctcttcccagagagggtcaacaagattgttagcatcagcggttgtgcccgcagccacccttatagtatagcaatgcggcacacgcagcgacaggtgctgatgatggatcccaactgggcgcgtgggttctactacgatggaatcccgccgcactctggtatgaagctagcgcgcgaaattgcaaccgtgacgtaccgcagcgggccagagtgggagatgcggtttggtcgccagcgtgcagaccccagcaagcagccagctctgtgtcctgatttccttatcgagacgtacctcgaccatgccggtgagaagttctgcctcgagtatgatgccaacagtcttctttatgtctccaaggccatggacttgttcgatctcggccatgcccaccagactgccactatgaaacgtcgcgcagagtctgaggatcgcattgcgcatggcggtggcgcaccaaatgtttccgaccccgcttgcagtctgacccttccagacaagccctatgaggagcagcctggatcaacttctaatgtagtcccgttggatgagtccgtttccgctgactcagtggatggtcctccccgggaccttgtagccggccttgctcctctcaaggatcatcctgtgcttgtcatgggtgttgcaagtgacatcctcttcccagcatggcagcagcgggagattgccgagacactccgtgctggaggcaacaaaaaggttgagcatatcgagcttggtgacgacttgtcgctgttcggccatgacactttcttgttagacctaaagaacattggcggcgcattgggcaagttcctgcgctagtcgcgtggtatattgcgtggcaggcgatggaaataatataaatttgtcaatatgtggttaagcgtgcgacattcagtatttagccggcgtttgcattcacgaatggaaatgagatacctcctctctgatttttcttgcagttttaagggatcaatggatacgtccacacagtatatacgtacatatttagccatcgtacggtaaaggaacagaaacgttaatttattatcccatttgattctatcaagttacaacatggtgaatgaagtccacaaaaataaaaggaaactcgccctcaggttgctctcagttttcataaccggcttccagctgtgtaaacggtccacaggcacgaggtgcgctaagtggtgccatcgtcaagcagatgcctgcagtattggcttatgttcgtctcaataacgaactcatcacagggcgagaaggagaaaagaacagaatgacacaccacaaagccacaatcccataatgtcatcatccacaagacaacagaagagaacagatttaaaaccaacaccgggagcacaagctaggatatttgataaaaacaccccaaaacacccccgagatttagttcacgaactaggagaacctaggacggtattcaatattcataaggaaaactgggaaacccagaatatcgttgatagtcgaatggttattgttagccaaagccgccaaccttgaggcatcaccttaatgtattttcagttgatctcagagctcgaaagtagtcaaagctgaggaggatagaaaaaaagggaggaagtgggagagggcaggtatttatattttgggattagagctgcagccacggagtccacgaagggaaggcttgttttgcaagtgatgctgcctattacccttcggtaacgtggacactgcgtagcacatcacatcatgaatggctctcttcaacatgtagaacaaggtgaacagacaactgcatctgacatctaccatttgaacacgatgataaaatcatagacccttaaaaaattatcagaaaggcaaccgcctatcacttgaaaatcgctagaggctgtttggttgactcttcggattagcaggtgttgttagtagggctctgggataacaagtgttgttgttggctattgtttccgggaactccacatgagagccaccttgggtatagcatgtagccgtagccatagccttgtagccggcgatttgaagttgggcatctgagcttggaggataccttgggaatataaaattgacaggaacctggaaagcacagatgttgattttatgcccaggggattaaacgttcttccgccccggtgctatactgcgctctgcctgaggcacaaacaattacaatacccggggcttttctactgcaagttctctatacggaagatgtttagttaggaagatagcccaggaactcttctctacaaatcagtttctaccaagtcctttgaacgtgcatttcttcgatctgggaatgcttatgcgccaacggttctttcagatctccggtcaatcacagcgatgtcacacaagaaaggagcagacggcacggggtttcatgaagagcaatttgttgtgctactattacaatgaaattatccttcggtaaccacaatatctacgcgcaaagccttacatatcaatcaatgcattacaaagcacactgacctgccgccgttcttgacgattccaaatcccattgtcaatttgccaataccagctttgcttatctggcacgtgctgcaaagcaacttgttcacctatcacctcagaggagctccgtggctgctgactggactactcaattcagatataaacagcgccgctaagctgtggatcccattccccactattgcccatactcgatgtcatagtactaagatccacacccggggccgtgtacaaaaggcactgaaatacgcctgtttctcacaattcttgggagtagcttctcacatcagtggacttacaccttcaaagaggatgtcgcagtcaaaggaatggcaaaagatgcttcgcggcgacctatactgggcatgggacgaggatcttcaggcaaacagaacaaggtgtaaacaggcctgcgatgatttcaatgccgccggggctgcaacaaggcgccggaaagtagagctatggagaaagtaagttcgagcgatgtgccctggatggtcatcgattattgctcagtggcctttgtgctgaccatacttgtgtccagcattgtctgcgacacacgtctaatgccaccattgaacccagacccgaaagaagacgaggcacttttcgaagagactgatcccttcgtcgatggaccgatttctgtggaccacggtttgaacttcaaagtcggcaaaggcacttttctcaacttcaatcttctcgtgctcgacacctgcctgatcaccatcggggaacgggtgctgtttggtccaaatgtttgcctgtatggtgcaacccatcccatggatccggctattcggcaagggctgaagggaccggagtgtggaaaagaagtgcatatcgaagacgatgtatggattgggggtagtgtgattgtgctggcgggcgtgcgaatcggaaaggggagcacagttggagctggctcagtggtaacgaaggtcagcatattgagatataatatctctaattccacgttgagaggagccaaactgacttctgcaggacgttcctcccttccattttgtcgcaggcaatcccgcccgagtcattcgccggattgaaacgagcatgaaccctgaatagcaacaatgatggtggtgtgaatgggagctaatggataccgaggctaatccgagcatcttttagtaggcttttgcaacagagttcactcttgagtgccgaatgaaacttcatcttcacactggggctcaagttaagatacatgaacagggtagtacaccgcggaagataaatattgctattgaaggagggggataaggttgcgaaattgcccgctactacctgggtgtcgaaatgcgccgatgccccccatcttgacgaaaattgtcaaattgtcacgcgagagcttgcatttcatcaccgagatggaacaagcaaaaagtcatagcgaggtcgtagaccgcgaagtcgtatatgatagcaatgctggctctgggccagaagcagcaggcagcttctcaatatccgatgacgatattctgcgggcccagggccataaagcagtattcaaacgatcattctctatcgtttcatccctcggttttgcgttcaagtatgtttcccactcattatatttcgcacttattatactgaactgtctagtatcacgaatgcttggactggcgcgctaagcaacttcggacagaatctcagatacggaggaccccaagtggctctattttctgttgtcgttgcttgctttgtgcagtggattattaccttaggactgtcggagctggcttccgcgtttccttcatctggagtaagttatctacggcgtgattgttgctcggacgtataatctgaattgcaggtgctatcttatagggccaataccactttgtctacataatcgcccccaagaagcacaagagatttgctgcttttgtgacaggttggatgtctatactcggatggtggatggtgacatgctccgacctgtctcttgtccccaaagcagcactgggtctcggtcaatttctacatccggacttcgagatcaagcaatggcatgtatactgcgtgtatcttgctagtattgctgtgacaagtcagaccccgttattgtcaggttgctttacatttcattgctgactcgggttatcctgtatagtgacgccccttctcttgtgccccaagaaactaccactcatcgcatcctggtctctatacctcgcattatctggatttgccacttggttcgtaacagttcttgttatgcgtcagcatacaaataccaggtcttatatcgtcagatctggtctgggtacaagtggatggaacaatggcatcgcctggcttctcgggattaccaactcgatgtattgtttcagtgccagcgacggagcgatccatatcgccgaagaaatgcgatcaccgggtcgtcgactcccacagatcatgtcagctaagacctgcctcattctccatccctaattccagttggttattaggcccgctaaccaagctcaggaacgtgacactagccattggcctctgtacagcggtgccgctgttagcagtcttgatagttgccatgaaagatatggatgaagtaatgaacgccggaatgccagccgtggaactattgtaccaggcgacaggatcaacaagggtgactgtggcgcttagcgtactgttgacaatcgtatacgcagcagggatttctccacagtgggttacctgtgggcgtcttgcatgggctttcgccagagaccgaggtactccgtttcccgatttcttcgacaacatagacgagcggcttcaatttccgcttcgcacgactatagcctctacggtttttgctgctatctatggtctcatataccttgccagcaccacggcgttcaactccatcattacttctgccgttacgctattgaacttgagttacgccattcctcaggctattctcgtgacgcgaggtcgtgcacagtgtctgccaaagcggccgctggatcttggtcgatggggatatatctgcaatatttttgcaccgctgtggatcacagtcgtgggtgttgtgatctgtttcccttatagtcttccagttactgtgggctcgatgaactggagtgcaccggttttggtgggattgtttcttatcattcttattttctgggttctgataggcgacgagttcaagggacccgatattgactggggcatgttgaaccttaagaatgaagcgccaagtgacgcctctacatgtggttgagtcgaacttaagcctgtgatttggacaacatggctgcatttgtgaggcttgggcagggtggtttttggatggtctcgggtcggctatatgcttctctcgacgttggccaggcgttataaccaaaccggcactgtctcgtgaaatttatacaagagcaagcaagcgccagttgaataaatgaaacaatctgtatttgattaaaatcgaagtccgaactagatgggaagaagctcccaagatccccaatcacagatttgtaataaaatatgccctcagattgaaaactaccatgttttgtcactcgtcaccggcgtacttgtcgtttccttgaaaggcgtacagacgaagcacatatacagggcctcggagtatgtaactgtattttctcatcaccgggatattacatgaggatggggatctgaaaacatccctcgatgaatagagtacttggaaggtaaaagggcgattggtgaagagaaccggaccagagatatgattttggagatctagaatatgtacagcaattctgagcgatgttagtcgaaaacgttcaaatattgatgcgaagccaagacagcacatagcaggaaatatcaaggtccgagtctcttcagatctctgttcattgctcaatcacacacttatgggccgatgtcttcttccactccgaggtatcagggggatgaagtccataccccgacgggtttattcaaccgacatgtcatgagaagctcttgtgaggtttatcttcatcaggacttggcaaactcgattgaatctgtgttgtagccaaagaccagagaaccagtttgaaaaagggaggggagaggaaagaaacatacctcttgtgatttacagcgaagcaataacccctgaacagaagcgttaacattgcgtcgtcccaagcgataaaaggcagttgctgatattgaccggcaaggtattatcggattcaacatcaagccgtgcctagacgcgtctttctcagacaggctctgcagtgacattgagcctgatagctgtatcggtctgtcaacaacaactttctatcggatgagatgatgcaagagcatatatgacactgtcaagggatcgcatgtgtgttgttaggacacggtttggcacgatgatggcgcgtagtcacatttaccgcctaccataccgccttacttagtccccgcacaattgactaggaccgctgcacgtgatagacagcgtggttccactgatgaacgcattggcttgcatatacaccccggtataagaagctcgtgcctgcaccggtcggctacttgtgatggtcagtacactctacatccagaatggctcccccggcatcaaaatggtggcaagagcccagcgataccgatctcgactacggattcgattctgacgaactggatactagatataacgaacctgaccgagacacttcccacggcaataaaagcaaaccgagagacatacagaatacggacgataagggcgtaattgcaagcatgtcttcttggctccagcgtcaggctggctcgtcccacggacagcttgcgacagcggctgtcgtatctggcgcagctgtcgcaggtgctatctttgggtaccagtcatacaagcgcaaggaagctgttcatgacctcaaggcctcgattccaggtattgatgatttacatactgcggaaacggtgagctgcaccagtgaagctgcgcatccattgcctagcaagctacaggataaaattgctgattggccggactatagctcactgattttggggctgcctcgaatggagtacaactgagcaaggaagatgagcgcagtgcagctttagctcgcagagcacaacagggagactacgatgatggtatgtgacatttctaggccttcgttctgcaaacctttctcatttggcctgtctcgctttggtagatttgattcttgaacagctcgcccgcaaccgcgtgttcctcggcgatgaaggccttgccaagcttcgatcgtcattcgttgtcgtggtcggctgtggcggtgtcggttcgcatgctgctgcttcactggctagatcaggcgtgtccaaaatccggctcatcgatttcgaccaagtcacactatcatcgttgaaccgacacgcccttgcgacattggctgatgttggcacaccgaaggtccattgcattcggagacgattggaacaaatcgcaccctgggttaccttcgattgccggaatgagctatacggaaaggccgcgtccgacgatctgctcggcccctggtctctgacacacgatggagagggccgtcgaccagacttcgtgttggattgtatcgataacattacatccaaggtagagttgctacactactgccactcgaactccttgcctgtgatctcgtcgatgggtgcgggatgcaagtcagacccgacccgggttgtggtcggcgacatctcgcttagcaccgatgatcctttgtcccgcagtacacgccgtagactcaagcttcttggtgtttcgtctggtgttgcggccgtgttctcgacagagaaaccaggcccgggcaaggctactctacttcctctccccgagggggaattcaccaagggtcaagttggtgagcttggtgttcttcctgacttccgagcccgcatcctcccagtactgggtaccatgcctgcggtgtttggttacacagtagccaaccacgttatttgcactattactggctacccgcttgactacaacatgggcgccaagggccgcgagaaactctacgataccatcttggctgctttgctaagtttacatgaaagaatgatcagacaagtcaccggccaagataccgtggggctccgtgccccgctcagcaaggatgatatcgcattcgttgtggaggaagtgtaccgggggaagagtgcgatcagtggcttgtctaacagactggctctcgtcccctggcacactcctggtcacgggtggaacatggatctgagccttgagaaagagggacagaagaccatcccgatggacctcaatcaaatggtttgcatgactaaggaggaagcgctccgacacgaaaacgaggtgcttaagggtggcaagaaggtggaagaggtgtatgatgagactgttctccaacgtgtaaacctgcgcagacgggaagcggaggagtatgatcagtaccgaggatagtgtaaaatgtacaaataaacaaaagcacaaaatcagatttggcgaacaacataaagaagtcgagcatttacccgcttgctacatgtgtatgttgtacctaacagaagaaagcgggtctgaggtatacgtcagagccgcgagggttaaattctgcctcttcttcacattcttctatgttgtactcccacacagtttaaccgaatgcagtacatcgagcatacattacacgtggaaataagaatataaatgccaactagggtgcaggagcatgacatctcgcgactcccatccgacagataacgagttccatccgaccacaacccaccatccctcctactcaaatcagtctccatattattctcgcccagttgattccgccagaaacggatggcaagtcggagcccatgaaggctcccagcgcggctccagttcccccgcggatgacatcaactcccccggatggtcccaaatggccctctcggtagcttccgcgccacgcttccggcgcttagtgctgatctacatcgcactgtttatatttgcatggatcggctggcgaatgctgctttctccgcgactacaagaccaaaacttcctgttgcattcacttcacccgacatctaagacagagacaggttggtggttcggggtaaattcatcccctcagcccggtctggttcagatccgcacattgaacccagacctggtgcctggggatctagcgggtgtgaaggcagggaaatccagtcggaagcggctaattattgtgggcgacgtgcatggctgtaaagaggagtgtaagtaacaacccccgaactatgggaattcttaaattgacgagtctgcaacagtggagcaacttcttgaaaaagccgccgtcaaccaagaaggtggcgatcaccttatctttgtcggtgacatgatcaacaaaggaccagacagtacaggagttgtggacttggctcgacagcattcagcatctagtgtgcgcgggaaccacgaagaccggattctgcttcttcgacaagagatggtgaagaccaacactcttgcaaaccccgatgacgatatagactctggtttctcagccaaggaacttggcgagcgtgcacttgcgcggtctttgagcgacgagcaagcccagtggctggagaactgcccagtgattctgaatgtcggccaagttccaggcatgggccaggttgttgtcgttcatgcggggctaataccgggaatcgagcttgagaagcaagacccttccagtgtgatgactatgcggaccattgatctagatacgcatgtgcccagtccgaaaaagaatggcatgaattgggctaaggtatggcttctctttctatttcactcctttaatcttgccgtcatattgatatactttcaatctagatgtttgataaacatcaatcaaaactgtactcaagcctcgagacttcgactgaagatcctctcgcagacactatgactgttgtctatggccacgatgcttcgacgtccctctctattcgcacattcacaaagggccttgactcgggttgcgtgaagggaggaaagctcacagctttggttatagaggacggcggaaagcaaagtcttgtacaggtatcgtgccgtggctatttaaaagaatgacagttcttcactgttgctcatctttgtagagaaatgcattcttataaggtggtgatcggaagtactgtaccatcggtctgattttatgatctcgtttagtgttgcaatcagaaggctgattcctggaataaataagagattactaataacacctgataatggccgtcacctaataataatggcctcgctgtcgagcttaagcctgttcaccgcttgtaaggcggggatatagaagctaccccgcatacttacgggggcgggatgaagtaaccgtggccccagggtcccttgatggccgagccaaccagacaagacattcgggactcagatcttataacgaaataccaaggtaatggaagatagggtttcttccaggataatccggctaagggccgtgaggctccgatcacgttatgtctcggtccaccttaattcgctgacactaaccctctttgtagcttagtggcagctgaatatgcgtgagaggtagcacggagctacggccccggagccggaccccgtatctcaaggtctgatcccagtaactataccgaggatgctccgtttcagtcggtatataagcaggtgctgacagcttgtcaagtacctgcttgtctatatctttagtctttatctatacgcttccaacagtaagatacaattgatcgtcatctaaaatcttatgctaacatctctagtgtctaacaacaagatcgttcctcttaccattatcaagggtgccggccatgagcacatccctattcccgagggcgactgcgccattatcgccgacttccactcaatcaaatcccagagctcacactctaccccttacctgaccactggactctaccgtgttgtgcccggacctacacgatacggcgcgtacgactacgaggagaccaagtttgttctcaagggccaaatcgacatcacagtaagatcccattcgattttgaaatctgcattacgaatgatactgataccatacaggatgaggccactggcaagacccaccacctcgttgctggagactgggccttcttccatgttggatccaaagctcaggtttgttctctgtactctaaccgacctgtatacacttgctgacccatttatagttctcaacaaagactgagggtgttgctttctacgctgtcacccgaccaatgaacagcggtcaccctaaccttgttggccgcgaggagagcactacaaagttgtaaaaatcaatgctattgtagccttttagatgaattgaatgcacgattcatgatattccgtctcgttcagggtaattacatatgtatagtgccaagtggttataagtctcaggaaagtgatgtttactagacttggctgaagaaccttgcgatagaagggttagaagattagaattacccctgccccagcttgtgtctcaatcgacaccactacaaagaaggtaaatacgcgattgttggagaacttaatcctaatctctatctcttaataaagagatagcgtccttcgctctaaatctcaactcttgcccttcgctatactattgctacaccttgatttatctctccgagatatccaataatgttataccatcttcaatactattgccacataccatgcgtcttgagcccgctactccatgccgtaccttactaccacagatgtaagcaggaaataactgtacctaagtaggactgagaacttactgtaggaaggactagaccggaagataactatcatcgaatatgtcagagcgcagagcccatgcgtcggaaatctgtcaagaatatccatgtctgatttcaactaaagaatgagggtatgtacagatggaatacaccacagttctctattcggattcggattcaggatcctcggggatctcaggatcccggaaagcaaaattaccatcgacgccccaaacggcgggtggggaaaagtcttcataccaaagaccgcccaaagcattagtgtgaacgaatccaaaacggaaatattccaactcgttaggataagtacgagaccaagtgaaatctggtaaatgctggccatccttaggtcggaagacctggaagcgctccacgtcgttgactaggacactgaggccgtcggcatggggttcaaggtccgggaacgagaagacgagattgtttgcatcggtcatagaaggtggatatatcttaggtggaacggtaccaagtttggcaccatcaaggagagcgcctggagtttggaggatcgaatcgaagccccagcgggcgatgccgtttataaaaagaccaataaggatgcctgagtatagaagactgggtcgcgtttgcatagtcgttccaggaaggaagagaagagaaagaatatagtggtggatgcgtaggttcatgttcggaacggcgacaagaatgagaacaactgcaaccaggatgccgtatatgcttatcgtagggaagaagcggccctcgcgacggaaacagtgtgcctggccaaaggcgattgcaatcagagacccaactacaattatgagagctgtgacagcacccggttgctgctggatatcgtggggtgtcaggcgagagattggaatgcgatcaaatgtgtctgtgttcagggcgccaacccagcagccacccagccacaggacagtcttgtcccagtgtgcatccaaatttttaagcgtgtgccggacgcagaagtaatacagcacgaatccaacgaacgcaccgggcagaaatcgaccgagcgcgattgacacaaggtcataatagctccccatagagggaggatcggacgccatggcgacttggaaccagacaatgaaatatatcatggagtagaatgccggtgccgatgtcacgactaatgacaagatagtagtccagatcaatgtgaaggcgaatagcgaccagcgcgcatcggagcacttgattgggtatgtctcgttcgagtctagggttgacgcttcattactgagtcggaatgacatcgggaagctcgagagaaactcgatactttcaattccgtgctgcgagctggaatagaagtttttctgctcgccggcgcggtgcaagatgccacatccgcccctcgcgtcatcaattagacctgcatgcagtgccgacgcacaaattgaggaatcgccgcggtaagtgccgctgtcatgaccatccacattaaatggcttacctccgacaactaacggtcggtaattgagctcctggtcgccaacaacatacggctctagtagaatcgcggctgcacagccagagggacaacggaacgcgaaggattggtcctcgaatgggcgacaaaggtcaccattcagtccgcaattcgtggaattgctcctagatagatatggtcaggttcgcaagatcggatctgcttggggataacaatagaaacacaccataaacggtggtgacacgacagcttgacgggctgcccataccccggaacttcttggcccgcaacggaagcttttaaagatgcaaagaacacaacaatccaaaagaataaaccaccaaaaaggagcgcgatctttgaacttctgtgtggaaatttttgatcaatcagacgcgccggcgcagcctgtaaacgagggaaccaagggttaatgtgatagacatgcggcggcgtcgggccgcggagccatgcacagaatcccgagggcgtacaagaaaacggcggatcgcgctcgaatttctccgattgagtatccatgtgttcttggggcagaagaggcacgtcgcctacttccaagtcaaagcttatttcatcgttgtcgcgggcttcatccttgtactgcgaccggatctcctgcaagggatactcggtggacgtatccggtgaggatgattgcgcacttgccccggaatactccggtcgcgactgcattttttatatacaaagttgtttgcctgagctctggagctctcagagggaaggaggcgatggaattccttttcagtctcgaactcgtcttggtcaggaatttcttggctttttagtcatccggattgctggcccgatccatggatggatgtcattagattagatctcagatctcatctcggacaagttcacaaaagatattaaaaaattcaatgtatattagtcccttaacctacagatattcttcataacccgcactcttcgaagatgtgacactgctccgtcatctaaaaaccaacaagtccaccgaatcactgaagattaacaatgttccagaatttgacttccttcaaaactatctcaggtagtcatggccggtggcaagttttcgagtccgatttagaccacaagatgttctgcattgaatattccatggtattgcttcaagcaaggctgatgtagcggtaggtttcatgaacccatgccttgttgcccgaagaacataagctctttgtcacaaaggcatgcttcacagcatcaattgtccgctttacacttccgagattccgtgtcttctggatattggccagccgatctagtacaaaacgtctttgttcttcattttccaggccggtgttcccaagcacaaatagaggccataacaaagtagccatatcaggaagtgtggagatcagttcaatcatcgacgatataagacggcttttgcacccttcagataccccacgtctcctccggtcgtcgatgtctagcttatcctcgaggcgttcattaaggtaaagaaaggcagctaaatgtttgacctgtgcaatcctctcgaggtcttctctgcccgtggcatgttgaggaagcgtctgtttcaagccaagaagagctgtgctaatatctaatgacacttttgcatagtattgagtctcggcaggggttaaacgtcggtatttttgtatctatagttatctcgtggtcagcattatactcggatagagcggagcagtcaagcagtacttttgccttttcggaagcatggatcgagatattgtttattaaagtcaaaaggccacgcgagcaccccatcaacatatctatctggcggatagatcagcattgataaatagtaaagtgatgatgaatgcgccgtacctcttcgaggttttcgctgtcagaccacaactccaagatgtcgtcttgatggcaattttcagatgcggtacggctcataatattatgagctacaaagtacattctgaaaaacttccataaatcggatgagccgcgagatgttgtgtggtcgatcagttgcaagccaccatgaagatgtgtcatccacgaaggagagcatccatctgatatctatgtccatgtcagaacgggatatactgcacgcatataggaagacagagacatacgtcgtggaagcacagcatcaagatcgaagctaccgtggcatctgcatgtacaccagcggaaatttcccgtcggagcccttgcagggccatgtgcttatggtgacagacttgctcggcaaattgatcctttcccagaaggcatagctgattcgcagaaactgccagaacggcgtgtcgaagggtgatagagacaaagcataggggaaccagaagggaaatgtaaggattatataattcacttagagagcaagatgggctgataccgcggataaaataatcgagaagataggtctctgtgtccggaaaagaataaagggggtggtagatggaagattggatcgaaaggtccgtacagatgtctatgctgttagggcaaacctgagctgaagaatgtgttcgaggcacatcatcggagtcttgaaagtcaccctcattcaaattcagaaagaacaagcggctagtatactgggttagaggaagtccttggaatacagattccgttttccggttatgtgcggttgtgccgggtcttttcgtccaaaccccttaccaaggagagtcagtaggatatagccagaagaagatggcggcagtaagtaccttcacggccaaagctaatgccccgttggatagcatcctctcgaaacatgattttgagctcccggacgcattcaagatcaagtctctcgcagcgtctacatcgcgggtgctcttcggtgcatttgatgtgttgctctacccatgtcagcgatttaattcctagccatgatgagggttgtacctttgcatttggcgcatccagttcgccttctggtgttttgttttcggcgtggcatagcgtgaaggtggaacgcggacagaggttagatggaaagaaggcgaagcggggacatgactcggaccttttgccgtgacaggcgataagggctagcgccggtagacggggagatgggcaccgccctaaggctccggggaaagttgtgcatctttacttaaggtctgtatttaattccaatccacccctgttcccttttcgtttatgtcttatcgctcttatgtcgaacgggttcttcaagggagttatcgccgggagatatcaatttgcactagaggtttctggccccagaacgggcagatatccttgtcagccagatatgtaccagataatgcctggcactgatcatcatctgagcaccctgatttgctcactgagtgctctctgagtgtacctagggataagcggcctaagtaagctatatcaataaaatgcgacacgctaattacatcacgtgcgaccctttctatttagatcgcctatcaaaaaaggactggcgcagtcaaatataaccgtttatcctagcggtctcgatcctatctaagtgaaaaactcgtagtggggctaaaggccgcagcattcgaggagaatggtaacgcgagttcagtgttcctttggtgggtaggaaatgcaatgtaacaaaggggcagtttcctctgttcagtaagtaaggcagagactttcacgctccccaccgaaactgagtggcttccttacttatgatgaattatgctcacacgctgcgtattgcaacatcgctaacgtcatactggcctaggatcgagcgctttggagttcctactgctgtaatggataagttcttgcctcgcagtgcggctgtactctgacagcggcaactgtaatttatgatgcgagcattgtagcattgagctacttccaaggccgtagcttcttgcgctgcagttgctttggcgatcaagaacggtctgatcagcacagtctggctccgttgaacaatctacattgaaaggcttggtacagaaaagcggtgccacgtaaaggaaaccaggagcaattgcgattgggcacttcatctattgaggggagacataaacttgcgatactagcgccgagcaagatatgactgtattaacgaaaccgtcttattatgtatcacagacatcagtcatatatgatcttagccttgaatccgcccatcttaacgctttgagtattatcctctggtgatcttgtccaattctttctcacacgttctctcacccaatccgaggctgggacatctggatcaacagcggtaccttcattaccatatcccatcttccgtaggtaagggctgtctaaagctctcagcatcagctgttccgccggcctcaagaagtacaatagccccaaacggtcattggatgcttgatcttccggcggtgaaatcacacggtggatgccactcttcaggtaaccattggttagaaactggagtatgtccgctaggttcacagcaataactcccggaggaatccggatgtgctgccagtgggagctttcagtgtgctttatttgcaaggcagccacaggctgttgaaagacaaaagtcatagttccaatatccgtgtggccacgaagatagaggtccttgtagctattattttcctccgaggaacgggcccgatacatcatgtaacgcagagagctgtcgcagtttgcttcgtagagatgcccgttgacgagctcctcttcagggagctcgagggaaatggccagcagtcgaagcagcttgaatgacacgttctcgtgcatgtggcggtggaacttttcaatttctccccagtattcccgaaagatatcgggctgaacccgctgggtctgcgggataaatttgaagatgttgtagaattccacattatcgtatagcccgggtaggatctccagggtccccaagggccgatagccgttgtagtttccttcttcaagaggggcccgatatttcaagcgctcttcctggggtagggcaaaaaatgcctttgcaatagcaaattgctcatcgatttccgcctgcgtgaggccaaaattcgtaatatagaaaaaccctgacgagttagctgatgtccctatttggtaggtcgacgtaataccagagtggtgtgctgctgcccttaactgttccgccaacttctcctttcctcccggtcggtcaaattcggacagatccagcatggcgaggtcggcatattctactgcactgctggtgaatcattattcttctaatggcaggcagtgagtgttacttacactcatgcttcgtttccgggagatggacatattttggcaacccgcttctttcattctgagtcgcaaaagtcgactcttgtgcttttctctccatagttagagaaatcctcaggtgttttaactgttgtcccagatcggagaccgtgtcaatcccctgggttgaaagggttcccttaaataatcgggcttagcttacaaaggcgtgtctttctgtcatagccataggcgaacagcccgagtccggattaagtctggtgcaaaggatgctccctgatcttgggttgcatcctcccctatcccaaaatacgacggttggaattgctaaccgattccttccaggtaaattggctctccttttctcatggcaagggtttcaaagctgcgcttcgctgaggatcctttaggacagcggtaagccatatgtacatatgatatgtgggtacatggctacgttggctgcttaactgcgcttggggcgacagaaacagaactgtcacatagttcgcttcgccgacttgtagagcttctccattagagttccaaaagcactaggttgaccgtatgtactgtagtttatgcgcatgctgaactgtctgttttgccgactgagatatagtttgaccgtgcaatgcctgggcaaggcgaatccttagtcttctgacgatgatgctctaaaaccgtactttttgtcacccagtaatagatgtcagttttctcgactaaccagcttcaggaatcagccagggatgagatctatttacaaatattatactcatacttgcttttctctcccatcgtgcacaggtgctgaaatgaagctcgcgtttgtgactattaagacccaccggctacgaaggttgccggaagggttccgtacaaacgaaaccgctacctccccggtcataaaattcagcgaaactagtatcctaatgcgagggtgtcatttggatcaccagccagccgaaacggtaatggctggtgagcttgtgcgccttgtgcttggcactagctaacaaattccaaaggaggcatgaagtagcaggtgggtcaacttaagcataccaagatttgaaaatttgcttacttgactagacaatcgcctattggttgctttccactgtaagggttggtaatatgcaacaccggtctagacagatacagtatgcagctgttgatcatcctcaaacattctcaaaacaggatggatgtatggattatcttcctgacaccaagctagtattccatccctgcattttgtaaggacatgtctgtccattctttagcacacgttggaatgctgtgcgtgctagctcgatattaagggagggactggagggtgttgtaagaggtcatgggcgttgaacaaattgttaatttttggcttcggtggtcatttatgacaggctaaatataaaatgagattgggttctcagcctcgctatatcgctatacagccttgctttatatgtcgaatgacgaaatttgtcggtggccgctgaaccatggtgagccaacctgcgatatagggcccccgccaagggcgttttagacacgaaagcctgccataccaatacagaaatataatcggtatgtatgtagtgggacagtaaccaagggagtactgtgcagatcaccacctgggtcggcgacaacgcgaacagcagggttgcagtttcaacctcacctccgccacggctgaacatcggtcttaccccctttggattcatggactgaccttaagcgacactacgcatagggctatgtctctgttgataacacacccgtgactggatattggacttaatgacataagctaggtccacatccaaagatgagtattgggtatttgtctgatctgagtccgtgctaacacctgctcagtgagcctcagcctgaccaccctcataaaagcggcggcagatcaaataggaaagccccacacgccagggaaaatccggtacatataggtacttttggaccgttatctttacaccgaatcaccatagtagcttttgtcaaacgcaggccaaaggacatatttcaagattcgtctaactactctcaaacatagccgcctattacgatgaagtgttgtttaatccataaaacatagtcctccgcatattaaacacgagaactcccccgttacgtagtatacttgaatgccttttgttggaagtcagttttatcagcaaaggcatccattaagtccccgtccgctcgatcttcctcagggtcaacgccaactgtagctcggcgattcaagttgtgcgcaatggcccagtagactgccatcagcagaacgcagacgcaatagcaagccagcatggcaacaaaccctcctgtatatgctggtgcttgatttgctcgaaatgtctgcggcccgatgagattccccacggcatagccaatatagagaatggaatactgcacggtcttcttggtattacccgctgtattagcctgagccatggatatccccacaacgtacggaccgaagtatgtatataactttagagaaatgattagtcggttgtacaatgctaagctggaacctggactcaccagatatataccaaccatctgaccacccagattcgttcgcggtaagctgtaaactaggatggcaccaattatagggacacaagatgccaacatggtgaccaggcatcgacggttggtccacttagccgcaatccaagagaagcagaatgctgacagggtcgacatgacaccggtcggcatgttcagcagggaggtaatcacgggcgagaaccctaagttgttgatgatgatgccgctgaaggttgtgagtcctccgttgggaatgttgatagcgatgttgaagaaaaataggacccatgtcttcggatcaatagccgcctccagggcctgatcccacttccagtgccggtttgtgatcccggttttgttctcggccaggcgctggacagcatggtacttctctctatcgttgaggaaaaaggcattcataggagagtccgggaggaagatcaaagcaataatagaccacagtgtcgaaatagagcctatcaacaaagtgagaaaggttaaatgcaaattcatccatgccagacgtaccgatgatcagaaaaaggtattgccaaatagaaagtgctgcactagatggaatatgaccgaccgcccacgagaggaagccgttgacgatagaactcgctgccgcaaataccaaggcattgcgagggggctgctcagactttttatagaacccagcgacgattagggaaattgatggaacgatgatcgcctccaaacaacctaaacaccttatcagtgccattatccaagccggatcatcacaactcacgtacccataaagaatctcaaagccattagtccgctccaattacgagagaccggcatgagaagtgccataattgaccagcctaacgagcatgcagataggtatttggcagagggcagtctgtggaccaggtacgtggatggccacatgccaataatcgcctgccactagattagaaaaaacgcaaccaccgttagagacactacgtactccgagagataagatggatccagcccaagaatattgttggcccacaagctgaaggtcatctttgaggccatatatggctgcagtactgatagcaaccttatcaacagcacccaaggtagcggtcataaagagctaagaacgggttagcttgctcgcgcgcataagaggggacaggcaacataccattggcagaagaatccaatccatcttgcgtaccatcttcttctcttcttccggggacaaaggtgcaaagccagtgctatgagcaaggtactctgctgcctcatccattgctctggagacaccgtgcttctctacttccggtgtctcgacagaaacactgcctttctgctctgccattgtgaaggaactcgaagagcgaacgatgtaattaactcaggaagaaaacggcgaccagcaacaaacagactcaagactgctcttataaagcccaagcaaactttccccgccaacgtcgtgaacctttcgataaaaggtggccagtggggaggccccgttatagatatcggctcttgaggccattggtgaaccgtctggctgataccgtgtcgaccttccccgggagaaaagaaaagagaaaaccaaggaacacaatagagtttgtggggagacccacttagatactccggggtctccaaccttggaaggcgactgggccgtatcgaccttcctcgacaacacgtaggacccgaatgaactttccaactcaactaccgtgacgaccttactctttcgtcaagatgtagcgtcgcaatccacctgcaattataaatttgttccaaatcccagaggaacccaagatgcaggtgcaaaccaattttcattttcttccaatattccaatatgacggttacgaagccgacggtcggaggcgtcaggattgccatcggtacggactttaaaaattctcgcacaaccaaaattctaccaactatagcgctaattatgctctcttagatcgaggaggcacattcactgatgtgtgggcgagtctgccgggaaagcctgacgtcgtcctaaagctgttgtctgttgaccctggtaactacgctgatgcgccaactgagggtaagaaaatatgactctcgtaacggagcactcgagaaagccggctgataagctattacaaaggtatccgacgcgtcctctcgctgtaccaaggacgggaaataccccgtggggttcctcttccgaaagatgacctagaatttattcgaatgggaacaacagtagcgacgaatgccttgcttgaaaggaaaggaaccaaacatgcctttctcgtaacgaagggctttcgcgacttgttgaaaatcggctatcaatcccgaccgcgcctctttgacctaaacatcgttaaacccgatgtcttgtacgccgatgccagggaaattgacgagagagtgacaattgaggggtttgatgaggacttggatggtttgttcaagtcggacaacgagataccaggagtgctcgtgaggggctcgagtggtgacatgatccgcatcttaaagcctctcgatgaagctgctgtgagacaaacactgcgagacctacgatctcaaggctatgatactgttgcagtgtgcttggcacattcctatgttttcccagcccacgaaaaccgaatcgaagaactggctctagaggaaggcttcacccatgtgtcgtgttcgtcttccgtggcagccaagatgatcaagatggtgccccgtggaggctcttcgtcagctgatgcgtaccttacccctgagatcaagaattatcttagcggattctcaaaaggattccaaggtggaaatttggatggtgtgcgttgtgactttatgcagtcagacggtggacttgtaagtcacgaccgtttcagtggtctccggggtatccttagtggacctgcaggtaaggctaaacctacatatgattagagggaactagactgatagcaaacaggcggtgttgtgggttatgcccgcacatcttacgacgatcacacaaagaccccagttgttggttttgacatgggaggaacctcgactgatgtttctcggtacggcggaaatttcgaacatgtcttcgagagtaataccgctggtgttactatccagagtccgcagcttgatatcaacaccgttgccgctggaggtggctccatattgttctggcgaaatggcctattcatagtaggccctgagagtgcttcatcacacccaggccctgcatgttatcgaaaaggagggcctttgacagtaacggacgccaatctattcctaggaagactcattcctcatttctttcctaagatctttggcgagaatgaaaatcagccacttgatgtggagatagtgaagaagaagttcatcgagctgacggatgagatcaaccgtgacactggaaaatcactctctcctgaagaggtcgcctgtggttttcttgatgttgccaacgaagccatgtgccgacccatccgggcgctgactgaaggtaaaggatatgacattggtatgtgcaattcaaacccctttgtggatcttatcctaacgcacaatagcgaatcataatcttgctgtcttcggaggtgcaggtggtcagcatgcttgtgatattgccaaaacactcaagatatccacaatagtcatccacaagctctcaagcatcttgtccgcatacggtaaggcgcttacctttagatggttcatgatgtgtactaacattccaaaggcatggcgctggcagacgttgttcaagaagcacaggagcctgttaatgagagatacaacgagatttctcgtggtcgactggaagaaagactttctaagcttggaaccgttgtccaggaacgattgatgagacaaggcatacgagaaaagagcataacctgtgagatgtatctcaacatgagataccagggcacagaaacctcgatcatggtcctcaaacctgccgacggtgacttcaagaacgagttcaagaagatccatctgcgagagttctccttcgtctttcccgacgaaaaggcaatctatgtcgacgatgtgcgtgtccggggcataggtgcaagtgagagagaagactgggagggagaacaacttggagaacaactgcgtactttgaacttccaacctgcctctccgaagttggtggagcgtatggtaaatactccttggactacccattatttatacccattactcattgctgtaggtccccgtttatttccagaaaacaggatacaagcaaacccccgtgctggtgctcgagagtttggcgcctggtctatcaattaatggacccgctgtgattattgaccagacccaaacactcgttgtggtaccgggtgctgtagccaaggttctccgctcccatgttatcattgacattctttctacttccactgcaactattgagcaaccaactgtggtcgatcacatccagctatctgtttttgggcatcgctttatgagtatcgcggagcagatgggtcgcgctctacagaaaacagcagtttctctaaatatcaaagagcgacttgatttctcttgcgccctatttggacctcaaggtatgcatacattacaattatatgttggaaccaactgacgtgataatcgacaggtgatctggttgccaatgctcctcatgtacctgttcatttaggatccatgagctacgcagtcaagtaccaacatgaactacacaaaggcaagctatcacaaggtgacgtcctggtagccaaccatccggaatctggaggcagtcaccttccagacataaccgtcattactccgatctttgaaaagacaggctcgaccgtggctttctacgttgcctcaagaggccaccatacagacattggcggactgggtggtacgtcaatgccacctaattccaccgagctctggcaagagggagcagctatccggtcctttaaattgatccatgggggagttttcgacgagaaaggaatcaccgacatactcttgagcccaggcgagtacccaggttgtaccgggagtaggcacgtccaagacaacatctcggatctgaaggcgcaggttgctgcaaatcataaaggcatggtcctggtccaggctctcatcgaggaatacaccctccctgtggtccaaatgtacatgggggccatccagtcgaatgcggagctggctgtgcgttcctatctcctcgatacactctccagacttgggccccatctatcagccgtcgaccaaatggacaacggaacgttagttaaacttacggtggatatatccaaagatggctcggcaaccttcgacttcaccggcacaggggtcgaaatgctaagcaacatcaacgcaccgccagcaatcacccactcagccataatctacacacttcgtctccttatcggcaccgacatcccactaaatcaaggctgcttatcgccaatcaatgtgatcatcccgaaagggagtttcctcaacccatcagctgggcccgccgtctgtgctggtaacacgcagacctcgcagcgcgtggtcgatgtgatcctacgcactttccgtgctgctgccgcttcacacgggtgcatgaactgcattgggttcttcggggagggtggcaccaccagcaccggtcagaagctccaaggctacgcgtatgcatttggtgagacaatttgcggcggctctggtgccacggcgacgcaagatggcgcgtcaggtgtgcatacccatatgacaaacacgcgcatcacagacgtggagagccttgagaagcggtatcctgtcattctgcgcgagtttgctatccgtgaagggacaggtggcaaagggtatcatcatggtggaaatggtgtggttcgcgatattgaatgccgggctcccctgagtttcagcgttataacagaacgccgaagtgtgcctccatacggaatggagggcggggatgatggtgagcgtggcgcgaactactgggtgaggaaggtgcagaatgagcatggggccgctgagtggcgctgggttaatatgggatcgaagaatatggtccgcatgcaggcgggagatcgatgtgtggtttatactcccggaggaggtggatggggctttactggggcagctgaggacaccactggcactgggcatgtcgagggccggggccagaatatcttggtcgggtatccaagggcatccgggagtgtgaacgcttatgatactgctcaacaagcatcaaactaaatatcccattagataattacattgagagaagttgtcaaagtctgggatatcagcaaactggcccgtcaggccggttttacatctcgacagtattggttggtgggatacaacgcatcccatttacattccgtgagtgcgtactatttatattttacggaattacaaaagctctacaaaggggttgtatattctataagcctattccagattcttataaattactccggaacattgtcggacaacggccccgcgctaaatctgcgctaaatcgtggcttcatctcgcagctttaagtcgaagcttctagcattttattctgttaggaagttctcgatcaagaaaaccactccttgatctttctcttatccaagcgcacattgtcaatatggtcgaaacctctcctaccctgccgccgctgcgtatcggcacccggcgatccaatctggccgtcgtccaggccgagggcatccgcgatagtctgaaaaggattgccccagaacggtcctatgagattgaaaccctccgaacacttggtgaccgagaccaattgaccgcgctatacgacttcggcgccaagagtctctggacaaccgaattggaggaaaagctcgtatcaggtgaattagatgtcatcgtgcattgcctaaaaggtaaataaaactgattattcttctatttcccctccgcatttgagttaaccggaccagatatgccaaccacacttcctgatacctgcgagctcgcggcaattccgccccgggatgatccccgggacgcactgatcgtgaagtccagcctgccttatacgagtataaaagagcttcccaaaggcgcagtcgtaggcacttcctcagtccggcgttcggctcagctccgccgtctctacccctatcttcgctttgcgaatatccgcggcaatgtggagactcgtctagccaagcttgataacccagccagcgagtatacgtgcatggttatgtctgccgcaggccttgagcgtgttggccgtaagtttcgtatcaaccagtacctgtgctctaaagatgggggcattttccatgccgtcgggcagggtgccctgggcttggagatacgcaagggtgatacgaaaacgcaagaattacttgaccagctggctgatcgcaagtcgactctcgcttgccttgctgaacggtcgctgatgagaaccctcgaaggaggttgcagtgttcctattggggttgagacagagtggatccgatctgatgtcttaaagatcactgcccttgtcgttagtctggacggctctgagagcgttgaagattcccttgaggcgagagtgcagactgtcgacgaagcaacggagctaggaaagaaaatagcggcaagattggtcaaggctggtgcggaagcaattctcaaggacattaacatcaaccgtccacctaaggactgataattgagatgaaatgaggtcaaggtgccaagaaaggcctgcggaattaaattgaagtccatgctggaatacgaaatgtgattggaaggttgacaaagtcagaacctagaaaccaaggaaattatagagggcactgcttgctgagtgcgtatatagtgataaaaccaaactggaggcaaagcacctaataatacaagaaccggtcacttctcgaagtggaagcgtcaccgttagaattgatatatagaaatggccaaatttcactgttcttgctattgctacatggcttaatgaaacttgttactgggagtcctatagtgtaagggagataagttatattgagtacatcgtgatcacagaatgaaggacaactttcataaaaaagtaagcgagacgatggaatgactgaaattgtgcaagtagataaatttgttttcttgttttccatttcctcttctagaaaaggggaatggtcggaatcaatgtggaaaaaaataataatagtttaccgaggatgcattatggggttcctataaagacccgtagagttaggacctgttggtgaaacagacgaaacaggcgaaacggatgaacgaagtgaaccagatgaaccaggagaaacaggagaaacaggctcagactcaggcccaaactcaggcacaggtcgtgggggcaaagcagggggataagggcctggaaccggccggttataagccaaataagtgtcaacaggaggaggagggcgaggccgcaccggaacccgcgagttcatacgagccatactagcggcaggcgggatctggagagcattgacatatggttctggcgcggaatcctcagcgcaggaaatcgtcacagggaatggcacaaccaaatcccagaggaatgactgggcctcgagatggtgcgcaatagcagtggggttcctgtagcgcaagaattcagcaatcagcatattcaaagtgtcagcggtgtaaatgcaggcccaatcaaactcggacatcgggtcctgtccggggcgatcgatcacaaccgtgaaaaatccattaggtacaactcgcacaagctcattggtcggacaatcaatagccatcatctgtccggctcgtttgagctgttccaatgacagatgaagctggtctagtctatcacggagtccgtcctggctcgataagccattgtttaggtcgtcaatgaggtgctggcagagggcttggaatccagtgcgtgcagtctggaagagccgggatgatgtgttatctagcatcactggcatggttcctcaccgatacccgaagccgaagctagcgggattattctgacgagttgtggtaacaatggccggggaagatgaatccctaactcgaaagccagctagggtgggttgtcaaggacggttcaggcgcgatgggatatgtatgatggccggatacagcctatttatattgtctctcagacgctctttccaacatgaggctatcattgtgaataataagaaaaagggaaccaaggtcaacaaggaagataacaaaggttagaaaggaaacacatcgaacaaggagatcaggataatgcccttgttgaggttctttgttactgagccggctatcggaaccttggagtatcggaaagtactaggcaagagtgcaacaaaacgtcggaggactatcaaggcagtatataactacctatagctgtggacaaaattacaacataagcctttctagccatagacaatgatgtccaaataaattatatgtatcgagaatagactccgaaggtagtgactttacagcaaaatcaatcaaagtgcaaaacaaagcaacattattcctccaagggtatcagcgtaagtcgtaatttcttgacatccaaatcatgaggagaaacacgacaggaaaacaaggcgagcaaacaagaaagcaacgtcgttagagactaacgtcactggtactgtgctgagcacgacgcacaatggtagtgcacagacttggccgtgaacaaagtacagctattgatgtctgcttgcggatctgaccccattatctagacggcggaacgaccccagcggcggcgactgttcagtatgtcagtatcaatcaatcaaagccatgttataaggtgcacattggcaacttacgttccatcagagttgttattgcggacacggaaggtgaaccaaatgccctgaagactcattagtacttggtcatacgtatcggacattctcatcacataccacgatagctgaaacaagccagacaatagcggaaaggaagctaaaggcctcagcagccttccaccggccacacgtctggtctcctctaaagtgccaggaccagatgctgccacatggcaagtggcggatggtgtcgacgaggacaccgaacgcagcgaaccaagcaaacgaaatgaggatgtccactagactccagtaagcattgctccatattcaccagatagtatatcaagcacatactaggccaggagaagaatccggacgagaatgggattagccatataaggcccagcaatatcgataagccggcgattacttcagtatagatccatcgcgactggggccaccagttgacatctgcgccgctgttgttgacctcggcaaggtagtgtccgatgacacctgcgacaacctagacaagagttagatgtggtttatagttggcgtagactgggaggtatttacagctgcaaaggcgatctccgcaacgcggaggatgatagaggcaaggcgcgaaatgacgggcattgttaaggtattttcaaatcaatgagccgtttgatagaaccgagagatgtgaatgtataaggagataatatgtgacggtcgagaaggtgtagcgtggaggagaggtatgggctggggaacacgagaagctatataacgtgtgaagtcgcacaggcaagcaaactgcgagagggagcgacagtgtattttaagcaagggacgaacgtgaaaatccaataaacagaaagaaagaaaaaagaattcaactaaaaagaacctaaaaacaaagcacggcttgcattaggcacgaccaatagagtcgatctaagcctcctagtgtcgtcagatcagttccatatagagcagttcctttccaacaagccaaggtcactattggtccaagtgtactccgtaccgtgaacaaaaacgtgcccaaccgttttccacttttcgtggcggactgaccgctgatgtggactgtggctgaatgctcatcaacacccgatcggagcaaggagtgggcctggaatagaggcgtacaggtactgcatagccctggaagtattcgaatagtacagagtacggagtactgctgcctccgtatcatccctgccttccccagacccagcctcccatgctttaaaaatatccttggcgttgagtacgggctctgtgctggatgatatacgtggcttgcttttcgagtgccgatcccgtcgactattggcgatagctctgatttgaaccagaattgggttgtctctttgtctccacccagggcgatcatttgttgctgtctgacaggtgcatgctgtttttccaggcatacaacatgcgaaataccgacaggggagatccggtttgaagcgaagagtacttgacacatctgacaacacttgacatcatgtttaacctgtcaactgactgctctcctccatccctgtctgtcagccctatgacgtgggggccacggagggactcgaatttgtgtagttttggccttacgatctcttataaggattatgtatgattcattctgcattgggttggttataaagttatttctaaaattactacatatgttgtagtagtatttcatgttgacaagtggagaatagccgaactacctaggtaggcagcatagcaaaacatcgaaatgtacatgtaggaagagcctagaaacatgcaggcgatgtgaagtgtacattttgagctaatagtgggccgttgatactatgaatagccagagtagcaagggccagaagaatgaggcacatccactttggaaaggccaagaggggaaggctaaattcgaaataatgctgcctacatacaacatccccaaaaataaaataaaatgacatatacacaatcacctcccatccgcaacatctaatacaaagtaaagtatcaactattacaatattttcacaggaatactaagtattcttccgatccaagtgccatgccatcacatcgcggaatatccccttggaaccagtctcgatagtatcgccatggcagggaatcaaacgatcaaagtcccactgatcaatccttctcatagacatattaaacgctgtccgatcctgtgccgagagaatataccacgcaaaccgtctctgccatgtagccgggggcttggtggacatcagcggcagaagaagctttgtgaggaaattagtccctgatgcttcagggctcttggaatactgctccttagcaggcaggttgaagagcagatccgcctcgatgaccgtgcgcgtgggcttatggagaaacaccagctcgcacgatccgtggccatatacatattcactctcaaactcggtatcgaactccttggagatcgaccgcggcagttgatcttccttcttgaatacgtgttcgaacggggtgtcctgatactccgggttcgattgccgcttctcgtagagaccctccggggctagaatctctgcttgcgggtacgcgttcttccatggggtaaggttgaggtggtgttcgagatctggcgccgcgatgtatttgacatttccgccgagcgactcgactgtctcgcgaacttcgggcgttaggccgacgggcgagaatactgcgagggaaccggtggcaagcttgactgtcgtacgcaaggagggttagcactgaatcttaatcaactgaagagtccccatgggcttgacaggactatgcgccttgtaggtgggttctgcaagggtcggcaactcacccagcgtccctcgcccgccaaactgcaggtgtccgaaccgtgcgaagggcagactcatggtcacaatttctggcgtcacatggcgaattaccatggtcgcggaagggttggctggaaagagctgtggcatgttggcgccttttgctttttccttgtgatttttgagttcgagagctgtaaggcgttggatgtctcagttgatgtgtcttcgacagatgtattttagagcccgcgcactaacagaccaaagaaatgtttcgattgtaaaatagtaaatgattgaagagcagctctcgaggtttaataaatgtcttacctcttagggaagcaagtggccagacttgggatgacgtatgacatgcttatctctccagggctccactttggatcgaggctgaccggatttgtcatcttgggacacccgtggacctcaggaattcctgggctgtactttaccctagaaaatatccacgaacgacaggaactacagaaagacggaataagagagtcagtcttacacatcctcggtattctcgagggggacgctcgacttttagatgggcgattttccccacatctatcttagaggcataagccaggggatggcaactgctttgtggacattcttagctgcaaccgcgacgggccggatccaagtcccactaggtggtctactaggcttttatggttagttgccattcgcgcagcagctagagcggttactatccggtctatccctttttcctagcagcgctcagtcacagagtctaatatccgggttctactttgataaaattgctgagatatcgcgctccgatcagcctgttcataattctgttttatctacgcctatgtttctaagtcatggatcagatgatccatgggtacctgtggagctgggacgacaggcatgtcaagtttcgcggaggcttatagtacgtgtcgactggcaggagttcactagcgcagagggtgacggctattgggttaaggaacctgaggggtttgaccatattctgaagttcctcgaaggttgatttgacgagacacgctgccagtgggccgtctatggctatacctatatacgtatatgcgtatgtagacctggaaggaaggcgccaagttaccgtcaaaaggccattcccaggccattccagaatatcaaatacctatacaggtaaaacagaagtgtaaggctaggaaggtgcatcccacaagatgatttgttttgcatgtcacgagataaaggacaaataggaaagtacgggatgtttcattctaggaaggtgcgtctgttgggaatataacccccccctttcaattccccaatctttcctcttcaactcttctcccagggttcctctctgggtgactggtgaagctccaaatgacatacctaggtacctaggtagataagtagcgtatcattgtataatcacattgaaatggatgtctactctagttcctggtagctctttgtcttctcagcatcctgggaaaggaacatgcattgaaggcaggaaaaacgttgagtgatgagggggaaaaaatttataaaaaattatggtgattcacaatgacaatgacgcccctagattttgcagatggaaatcgagagtagatgcctgcaacggaacagaaggcgatgcgccatggcgccgagatcggtaaaagaaaggtgcaacaatagcggattaaatggctgggaaggagacggagaaataggaaatggcgtgaagtaggtcattgaagcttaagatagtacattaatgcaaggaatgatcccgttgaaaatttatccatatcggccgacgggaacgtcgtggcgatgaagatccttggaccattccggtgcaaccttatcccgctcatagagcaggccacagttatggcagagtgtctagacatgatggttagaaacagttggtcacacattctagagtgaccacttacccgtgggccatctggaccatcgcgcacagcccaaactgctgtgccccacaccgcacagttcttgcatctccagctttggcgttccctgtaggcacaattcattagtgaatattccagtgagatgtagatatgcctagcagccacataccattcggaaagcgtcccaccgccgccaccgtacccagcccctgatccggtatcaggagttccccggccaccaggagtgccacttctgcctgtaggactcaagctccggaatcggcgcttgcgcttattcctttctccacgtccgagcggagtctcactatctacctcgaagtaattgccactggtctgccttgagacctcaggtgtgattcccgtagtagaagagaacctagctgtttctcggcgcagacgtcggatctgacgctcacggtcaccttctctccgctcgatttcttcctttgacagtgtctcgacctgaggttgccactcatcgcaaatggtttcagggtcgtaacgccagccagcctccacgccgttggctgccaaattctcgatttcgttgccgtagccggtgaggccgctgacaagagcaccgctttcgcagacttcctttttgaacttcaagactgcctcgtatatggcatgtgcaatcgcactaacccattcaccaccaaggctgagatctgcgcaagtgatacgcgcaaactcttcagccattccgggtgggtgtagtagagaccactcgaatttgtctgtgtaaagcttgttttgcaggttgatgttgagggtgatcaagcaccgatatgcgtcatctgggttcaaaaggctgtcgtttaccagcgcttccttggtcactgtcacagtggacgtcacatcgggccggttatcaggtgtcccaatgttggcggcagctggtgtcgtcgacgtgtctcttgacggttcagtctgtggcggagcactgggcagagtacctgcatctgtactctggaagagtggatggagagcaacgccagcgtattcctccagctgttgccggatctggttgctgatggtcatggtcgtggcttggggatttgggagatcaagatcgcggacgaatccaatagcaaattcttcgggcgtggagagtgattcgtggaggttccataagaaggtatccttaatacggaacgggggtaatgggtcaggtctgcgatacgcaggaagagtctgattgatgctagggtccacgactgtgcgtgggaaagggaatggctcaaggggttgatgagcggggacttcgacgtcaattcggataggaacgagtgtcaaggggagttgcgcttgaatctgcagttgatcggcacacctagaatcaccacgctgtatgttagccagatttaaggatagacagggaaaacagaggccgctctcgttaatggccacatcagtccagacaatagggaacatacgctggtcgcagcattctcttgatcatccactcgcgaaagaggccttgcacctccaccggcgcatgcacttctttgcccagcttctctgagtagggcaccaacttgtcggtagcggattcttcacgccgaagactcctcagtcccgtcggccgccggggcccatcggtctcatcaaaatcctcgtcatcaaaaccatcttctgcgtaattgatggctgtggtaccacgcttcgtggtgcgcggagtcgggccggtctgtgacggaggattgacaggtgtgagcaacgcgtttccatactggcgcatgcgcgggggataggaactgatatagcctcggagaggggacatgttggcgactcaattgcacaataacatgccccttcgaggtatgggcgggagaagagagagcttgcgattgttttgatccgctcgatgttcgaagggctgatcactgcagtgaggcacaattgagaatggcccaagcgcgaaaagtttaacaacgagtacttgtaagatgccacagcataaagtaaatgtgtgacaaaaatcaagatcgcgtcaaaggcatccagatatgatccagttggagagattggctctgagatcgatattctgcgcgactttgcccaatccgacgctagtcccattccaaggagggcatcatgtgatttgtgcctcaggccagcacgactggaaaccatcatagtaagacaacgcagacatcaatgggcgtatcaatgaacaataaaagtcatcaatacccactggcctttcctcatttctcttaagccatagctacatatgtacgtattggataagggctcattgtggtatgaaaacagactcaaatccaaaacaagcaaacggaatgtgaggggaaggctacaatttccaactagacctgcactatatattcaatctccacagccaacctaactgattcacaagaaaagaaatttaccaatcagactagaaaatggatacaccgaaaggaaggagaacacccaaactgctgagtacgccagcgctgttgtcggtaagatgaaaggttgaatatttgttgcagacatatttagatgcaactttaggaaaaaaataacagtcgaaacttcgaggcacaaggccgggggaatgataatcgcacatgcaagggaaagaagaaaagaggaaaaacaaaaaaaaaaaatagaaatcagcggagcccaataacactctgcgatgggattagctataaagcgttttaagtgaggattggggccttaccatctccaaagtccacacacgccggatccagacctttactggcccctcgacgccctcgacgtcgtgcagctcaatgccctcccaccagcagcggcgggcaggtttgcgccaaaacaggagaagcttctgggccatgcccacggaattgttgtttgacaggtctccgcggatatcggtgcggagtttggccagtgcaagactgcagattactgccttgttaggctccggggcacggtggccccactggtcagcacgatcaaatcctctacattgtatattagcattggcccacgattgtaatatcgagttcaactcacccggctgtcagcatttcaataagatgctgttcggttgatccaatctcctcgctcttgcggagtccagaaaagatgccgttctgtttcaacaacgacctacccgccccccgcttgacgtcaagcatttcatcgtgcccaatgtcggcgcgagggggaatgacatagaagtcgagatcctctcggaggacaatgatgccagcacggtcctggagcatgtcacgggctgatccctgcatgggatccgacatttccatgtctggtgagtttgagccggaaggcagagatgtggggatggtttgggcaacagttcggaagaaatccagcatgtactgaagtgagaccggatcatactagataatatctgtcagaaagaatctgatactcaagatagagatttgcgtacgtcaaccgggaatacatccccgtcatggaaaccatttgtggcatgtccatctgggaggaggccattggggaaaagagagagcagaacgaattcaggcaaagtcaacagctcatctcgtgaaagggtgaaccgcgtaccactatcaacttgttagactatgcataattgagatatgaatgaagcgcgatcctaccgaagatcaagaccgacgtgttcatctccaccgatgtctattataacatgttagcgaaaagcacacaaagcatatttgattgtcaaacacaccaccaagagtgttaattggcggccccccagtctgctgaacctgggttatgatactggaggcgcctcctgcagcagccatcacgtaggtgaatgactcaagtggactatagccttctgtgtatggcggtggtggttcaccgtcgtcggacgagccttcgttttttggttcagtgaaagacgcttttgtgtcagcaactgccgaagatggggccggctcgagcgactcctcgacaggcgctggaggcgctaaggctggaggacaagctggtccaggttcagtaactttatatgggcgattggtgtccggaagtgatgagaagacaagagatgaaaacggcggaggatatgcgggtgaggaactcgacgctgatgctggggagtgcggtgggggtgcagtgtaataatcgtcgtcctcctctagggagtccgttgaatgaggcggacacgccgtggttgaagggtccgacggcggcgtttctcgcgacaccgtggtttctattatcgcctgaatcacgtcagacaggctgatttgggcaagcaaaaatgataaaatgctgactttagtctagcaatgcgactgatctgggtcgagtctcgtccaagtcgctgtgttcaagagtcttggcaactttccaattcaatgactgactttcagcaccaggatgaaagaatctttgtctccaaaatgagtaaaagagatatacgcttcatctgctagattcgcagtgattgagtgttagagaaagagagcgcttaagaggttggggaagacgggtagatcaacttgggacggcggtaagtccgagcgcctcactagccatcgagacattggcacgtgccgtgtcctctgtgatttcgtgttagtttgttttgattttagttttaaactgtgggtttcctcttcctagaggccattattattgtgggatgaatttagacgtgtctacagcgtagtgaagtcatggtaaccttaggtatgcccatgcttagacctatttccagccggtcccccgcaaaaccgcctcctattgatctctcatttcatgccatccattgatgactgtgaccatcttttggtttttgttcctaacgttggaagaattcaagagtattgtacgtataggaaccattttcttttttagtttttctggaatactcgttgtcaaactcgaagatcatcttcatagtctgtataaccttggaatatacctacctacatacctatgtacgccacatagataatcttaaaaccaagtctcggatatttactatgaggatcacaaggaaaacaaaaagaatcaagtgtgacttggtatgactagtttggtgtggaataggggtagtcacatctaggcaatgacaacgaaagtcatcgtccagacgcccctgagaagagataaaagagataaaaagggagggtatttatgtgtatatgtaacgacttccatgggagagagatacgcgctatatgtgcatttcatttgtgtacttcaatatttagatatttttaagtaagtcgtgtcagacgttacgctctgcgaagctctgaatcagaccctcgagagtcggttcatactctttcaagctgacctggtcacactcaagaatggtattggcctgtacaaagaccttacgtgggaccttgttcttcagaacaacctcacgaacggtggttccccaccagctgtcgacagaggtaatatcgtcgtacaagcccttaccagcctcaacatctgcggtattcttgtacacatgcagcttctggaggtacttctccacggcaggacgtccgtgagtcaaaatcttggaccggtcaagatgaatctccagatcagagagatcctccttgctgtaagacaacttgacgaagtcatcaccggcatcgaggaaggtgcgcagaatactataccgagcctgcatgtgtgcctggccccatttctgggtcttcggatcccagaactcgagggcgaccaaacctgcgcgagccatggagaggtaggctacgtacaggacgtcgccggcctcgccggccaagtcttccttgccatcaccgaatccaaagatcttcaggatgccaaagtcgcagccaagaaccatggccacgcactcagcacggcactcctcatatgacgaagcaattgaaccgaataccgagctccatgtctgtccaggcttgtaccaggtcgacacgggcttgttggtgacggggctgatgggtgggttctcaatgtcgaagttgtacttccctggcgctgtctcctgcagcagcttaccagttccatgacccagcaactcgtggatgccgacctggacctcaaaggccgggtcgcggaatgcgcggaagacttcctggtctctctcagcgacgaaaggaatagcctcgttaggagccttggcgctgagaacgttgcccagggacacattcttgaagccaaggttctggcgaatgtcatcataattaggcaggtttatgccagctgggagacccgagcaggcgaaactcaagacctccaatgaagtgaagtcggggctgaggaacttgtccttctcaaagtccgtaccccagggcagcttgggaatcatgctctcggcactgtcaaccagcgtcccgaaagctctggtgcgctccagattgacctaaaaatgttagagacagcagtagatataaactcgtcacgtgtcataccaaagcaacgaagccttcccattctccgcgcacaccatgggggtctctgtatgtttcaacaaatcccaggtttgtctccaggactggcttttggtccttaacccagatgcgctggctctccttgaaagcctcgattgaaccagctccaaatgaaagagcatatgagtccaacatcttcttctggttttcatttgctgcagcaagtcccgcctgcttaatgctgtgcgcgatctttgccatctcttcctgatggtcaccgaagacaagacgcagcgtctttcccttcaggtctccgtcaagctcgaatgcgaccgcatcgccgaggtcccggtccttcacaggaggcgaagaaacaccagatgcgatcaaaagctcgaaatcacccgaggatgtcttccggattctagtgttctccaacgcaagtcccttcttctccatcaagtcaccaattgctgtgatttcctcctgtgagattgtcggggaatcggggtagtaggtggtcatgtgcccgtgcttgggatatccgaggtgcatcatcgactcttcactggtctcgtatatccctcctccagtggtgctagccttctggaaagccgccttcgtctccgcagtagccgatgacagagcttcgaatgcagatgcggacagccgaggaatgaacttcgagtctccaaagcccttgtaatttccgcagttgcctaagaattgacccgcatattcaaggaagaaacggagatcatcggagctgacttgtgtcttctgggcgaggctgttccagtcgccattggaagcatggtacagtgataggatgaggtcgtagatgggttcggactcgggggaaacctggcgcagggtgactcgagtgccctcaaatgcggctctgtatacattccagaaaagttagctgccaagagctcttagaaggcgtggtattggcgggtgtatcgcaggaacaccgtacctgctcatgaagtgcgcatatttcctcaagttttggtctttgagggtatcgaagtgtgacttgacttccagtctcaccacggtaggaggggagtcagctaagtaatgctgtttgatgctttcgtccatggcggcgcgggttagatgagaatacgaggagaatgtgtttgccagtcggggagtcggtaggcgcgagattcgatggaggggtaacaaaggtaacacggatctccgcgcaatgccacgcatagagtgcatacggaggggcttcacgacgaagtatgacatatcatgaagaggcaccaatcaggtacgtgtttcctttgccacggtcggatcaccaatggagttccgatctacatttgcttggcaccgttttgatttgctacctaggtaattgattgttctcgttgtcactttgcttaattacaactgttgcagtgactatttactataccgagaatgtgcaataatagaaatatgtagcaataacaggaaataagaaggggtatcagctgaaaataacaagaattgtccttatatcagactctcatacttgtccaatccttgcttttgggttccctgttgcggtgtcgcagctgtgccttggaaagatgttaatctgttggctgtgttcatcggaggtggtctcatagtgctattggtcaccatgtttcctgcaggaggagggggaatcgagaatgaggagtagttgggtgccggttgcgccgttggcccggacgtatgattcgagggtgtcatagtcggcatggaccccaaagactgacccggtgggccggtgtgggatcgaagattaggattcgctggggctccccaggtagaagatgagggttgcatagtagggaagacttgagtaactggtgaagcttgccgagcaggagtaagagtcgggaaagagcccagtttctgatctggagtgatggaacggaagccaatattggactgctggtttaaggcattcgcttggtgtgccgtgcctgcattggttgaagaccaagagaatgaaggtgacatgctcggaaccactggtgtggctggcttggctggctccatactaccccacatatctataccctggtcattcgcaggagatgccttcttcccaagaacaaggcgctcgaaactgccagcaccgccgtccgcatcgggcgaactgaggcctgtggcggactgcgaaaattcgtcggcgccattctggaaaccggatggtccagcgccagaggatagctcttgcagctttttgctttgttcctgttcaatcctcgttgaaagagtttttatcagagccataaaggcattgaactgtttaaggctcaacaaaggcccgagactgaaactccagaggaccggcagaacttccaaagccaggaattcggagtctgcgacggttccaacttgacgaaacaccttcaacgatgccatcatcaccgacggctctttggtcttgatcgccttgagagacgggacgagcttttcttgaatagtatacttgtccaatatcgaggttttggctggttttggcttagtcgcctggattccagacaaatcatcgtcaagcccgtctgaaacttctgcagaggcaccgcaaagcacactaaaagcttccagactacgaaccttgatagcaaggctgctagtgcggctaaaagtagcagcaatgggagggaatacttcattcttgactgtactaaagtcaagaactgggagcatcacagggaggcatttgagggaagcatccaccaaagagtgagtgggcgaatccagcccgagacgaatcaggggtagaatatctaaaaaagaaatgtcagatgtaggcctaaaggtttccattgacgaaacccaccatctttaaactccatccctgaacaattatcagcaatcaaccgcatgttatcaagcacgaccatgagaccggcatctttctttgagtctcgttcagcaggccctttgcccgaaccagttccaaagacttccttcagacgagggatgattttctctgggagtacacggcgtccgttgggaatccgctgaagaataccaaacacattttgcaatatcagcgcaagcagttcccgatccttcaattcgtccatcaacgcccccaatagctttctctccaagacagaaacagggaaatcaggtagtacccgttgtaagccacgcaggaattgagacttctcattgggattctttgctggcaaggattccagaaaccgaatagtggaaaccaacacgttgtcaaagtactgtgattgctggaactctcgagcattcatgcgttgggcaggccttctcgtaataagccttggtaggacatgggacactagatccttgggaatcggcttcgagcagaggaaattattgttctgcgacggagtggaagacggagagctcagcagtttcttatatgtggacaagcttgcgttcgtttgtagaggagaggcatgcggagagttgtacagagcgatgatgacgagacccaaagaaaagagatcggcagccgacgatacattggagtccagcgcaaagtctggcgacgtgtagtcaaggctcaattgtactgaagcgggaagccttggttcttgatagagaacctcagacacagccaatggcggcagcgatgaacgactttcagaagaatctggaggccccgcaaatcccagaccagagatcttccaatctgatttggcattgatatagatggcctccgggttcagatttccatgcactaagcccgcagactcgtggagaaattcaagacccttagcaacttgcaaaagtcccttttggatttccaactcatcaatctccatatctcttcttctccgagtcccatcagcctcttcaaccacataccggctgcttcgcgaaccagcgcgtgtagtattctcttggtcgtctttttctagcagcagcccggaaagcgaggcggtgatatgttccgtggcaaacatgagaccaccattacgcgtttcctccacaggctcgagcacctgaagaatggatgggtgccgtaggcgcgcgagattgcttgcttcgcgcttaagtcgctcgatcacgtcgtcttgtagcttcttgggggaggacccagaacttctcccaaatccactagagcgtgtctctagagacttgcggtcaaagataaacaccgacgccgccgttcccgtggactttttctttgcatcgtggattttccaggggccggagtacacggtggggttaggtgagatttggtaattggcagaaatattggagctgaaagacttgagcgcagatgagaacatggtgaatgatgccgcagacgagaatcggttggcacgatagtaggcggaatgaagggagtcgttcgtttcacagtgtcgtcacagtgtagccagcacaagacatgtttattttcaacaacacagtggaatttagagagtatcaacgggaggtgagtcgaggttggagtttggtggctaacaaagtcagaagcattagctcaaaggcttaaaaaaattattatccgcgggttgcatacttggtcaataatcccgcgcaacacgacctcaggttgatcttcgataacaacactcttcgtatcggaccatcacgtgattgtatcaatatgtacactggtgcctcaggcattaagattttcatcgccgacgcaacaggcttgaactctcaatagaacgcgatagtcaaatccaaaaaagacatttcgtgccatcttgaatataattaaccttgaatcgaatggatcagatctctgaagtcttacgatggcgcagatcaatccccatacctagtgcctgtgccacaaccttccggtattacgcttagagagcttctagacgtcctcctgtggaactacctaggtacccttctcagtccatatagatcgaggtctgctatgaactcttggcaggtgcctcaggccttcagccctactgaaagctcaggcaaccgatacaaaccgcatggagccgaatggagccgaagtcggcggtacaactccgatttgcagtcgctgattggccaaaacggcaactccattctttatcaggagggcggtggcagaacttcacatctggggcttccgagtcatcggagttgttgtcgagctccgcagagatattacagttctagtgcggagtcatctttctggttgtgatataaatccccgttgacctcgtcgatctcagtacgtttatacttgttccagtgactcaattgacactctctccactctatgcccctggctggccctttggattattcctaacaccaccacagtcatgaagtcgctccaccaattggctcgccgacaggtactgaccgggcttgcaatgccccgcgtcctctcctcacaggatactgccaccagccgggcatggcggagagctttcagcgcctccacggcagctgcctcccagctcccaggtcttgacgcttcgaaattaactatcaccaagaccaccacaccgaaggagcctatggactccaaggatcttgtctttggcaagtacttcacaggtaagggaatttctgcgctttgttgcctttcgggcactgactggaagcgattgtagatcatatgctctccgtggaatggacggctaccgacggatggcacgcacctcgcattgtcccctaccagaacctcagcttggatcctgccacctgtgttttccactatgcgttcgaatgtttcgaaggcatgaaggcgtacaaggacagcaccggcagcatccgtctgttccgccccaacaagaacatggaacgtctaaataagtcttctgcgcgcattgctcttcctacagtggacggcgatgcactgacaaagattattggagaatttgtgaagctcgatagtcggttcatcccagagtgagtatatcttgcgtacatcaaatggacatccttgctcacctccatagtgctcgcggttactccttgtacctgcggcctaccatgattggtactcagaagaccctgggagttggccccccaggatccgccctcctgtatgtcattgccagtcccgtgggtccttactacccaactggcttcaaggccatctccctggaggccactgactacgccgtccgcgcctggcccggcggtgttggtgacaagaagctcggagccaactatgccccctgtattctgcctcagctcgaggccgcatcccgtggtttccagcagaacctgtggctcttcggcgaggaagaatatgttaccgaggtcggcactatgaacctcttcattgctttaaagaacaaggagaccggacagaaggagcttatcactgctcctcttgacggtaccatcttggagggcgtcactcgtgactccgttctgactctcgcccgtgagagactcggcccccagggctggaacatctccgagcgcaagattcgcatgtccgaagttgccgaggcgtccgaggagggccgcctaatcgaagttttcggtgctggcactgctgccatcgtcagtcctgttcgtaacatcagttacagaggtaagatggttgagtgtggtttgaaggaggatgaggaggctggtgagattgctcttcagatgaagaactggatcgagcgtatccaatacggtgacgagaagaacccttggaggtaagttggcatcaatctttctttcttttttttttctcttttttttaacctggatgacgatatactaacaacctgtcagtgttgtgatctaggacagacatgtcagataaagggcttctgtgcccagactttgtgtggccgcagaggctttaaaaagtccttgctcaggcgatattttcttggtcagttttgcattttgcatgttgtttggatatttgaggtaccgaagctaccaaacagcagcgggagtcttttacatattcaactggagcttggtgctttatataggaaaatttcctttgctattttcagtctttcgttgaatccacaatctcgtagagatatagtgtatactccgagtgacacatgctgtgggattgacacgccccaattgctgaggggggaaatataacctcgtcaagtcagtataactgcactggttcatcctaagtcgtagtatagcaacacacgacggggtttgcagtcgggctttgcagaggctattcgaacattgcgtcattgggatgtcccttgtatatcaattgagaaaaacgcttgcagtaacaagccccttttttgagggtagtaaaaatgaaacggctccagggcgacggattgctcgctgatcacgatttcccggctttatggtagactcctatgttcccatcacccaaggcatgattcaacttcattagaggtatttttgatggggtgtttggttctatcatcgcggatataaaacagtttttagtgacgtggagtactcggcacataatcacaatatgggtgccattgtagcgtactagccgctgcatgattttcaatgggttcagaccttggcaaagatatgccaagctatgtatttgatcgtaggccatgaaatgtagttatatatcagtgcggaacttccaaggttgttcgtataacacgatgactcatatcagatttaccgagagaggggaagaagaaccaatacagcatttgtttatagatacagtgaaagtaagaatcatcaaattgtagcaaaagaagaggccttatgccatctaccacataccatactaagacaaatatgacccgctcgatcgacagagtttggccgttgatccgctagaggtattagattgacaacagtctagatataatatcgtagtctgtttggttgacatatcgtcaattcttcgcacatctaggtacgtcctcacagattacggttactacttggcaggctttgatacttttgatattcagtgtttcatttacataaatatcgttcaagagatagactattcggggggcgaagtaagaaaagtcatgtgcctctggcttcatacaggacgctgattgccagaactggtagccaaagccacggtgatcaaaatctaaacggtgaagaacggtacttttcatgaaaacagtccttttttttcccccgagacaggtaactctatctatgccattgttcagagaaatctttaccctagatcattcttgcagggacggatataaccttcattcaatggcaaccgacagatttagcaccaagcatagatggtgctgccaacccacaaaacgcattacctctaagcacatggatgaaaattcggacaggttagttagactccggcttgaccttgtatgaacacagtgctgacgattgtcagccacccgttgccataaccctgcctgtttctacgaaattccatgtttcccccatatgctacctgagggtaaaccctagagttaggacgtacaagccaatctcctcgcaagggctaaaagacccaatcaatgtctcgaattgatagttcgggtggatgaatcacatcattacggagtacagcctagactaacggcagatattcggctgcgccttgaccgaaaacaaggtaaaataggcgacatgcagcacgtggaccacgtgggatgaggcgaaacccagacgcggcgagtcaatcgagggggaaagcaaaatgaaataacagacgggcttcctctgtactagagaaggtttcaggctcagtccgtacgccctctggctacagattgggcaaaaattgtaatcgcagcgggacacaacaggcgtttcaggatgttccgcatggataacaatgggggttgttcgatctcataggctaaatttagtgctcggcttattagggatattgcaattaaggcttttatgaattctattgtatcgggaaataaccggacttggtgggagggccgtgtggcctgggaactggccagcttcttatcttgggatacccacggcgagagtttataattattctcttccggacttattgttgacctgtataggacaaacatagtaaaatgcaaacttggataagttaagtgaatggtttgtggtgtgactcgagcacttagaagaaagcaacaacctggacattctaaccatgctcggtttgcagccatcgactcccattcggagattgtgtttgatcgcatccagctttagcactggacgccttgtccgacgtgcctaggaagaattcatttggagcaaaataggatgaagatggccagcaggtgcactacgatggactttcgcactcggtccatttcacgtttagtgtaacaatccaaagcgagaacaacgtgccagcacgacgcaagaggctcggagattgccgtcattgatattcctcgagtgacaccagactcccaaaaaaataaaaaaaagaataaaaaaggaaaaagagagtaaagcacaatgggggaaaagacgaggcattccgcagatatgcgtgtgccatgggaggtgcatctcggacacagcaaggtcgggggctgcatgatagtccaccgccagatacattcttctagattgttattagaaggctcaaaatgcaacccatccaagcatccggggacgagaatggtatgtgagtggctataatccctgcaggagcaagagtttccactaggatggctgtgcaattcttaaaattccaactggagacatggacagcattagcggtgaagtcaactatgtaccgggtacctgagctgttgtgctcattgagcgtgtcactgaggtcatgggatgcctctccgacattactcgatcaggaataagaaggtgtccagctcagccctatatagggagataatcaccactttcgggcgacgcactagccaagtaatacgcactgcattcctgttattaactcccggattggtggagagacctattcatagcctcgtttgtcttacctgaaaagagcctcttttttttggggatttccctctaaacccccttgtccggactatgatgtacttcgtatttctgccaagcatccgtgtctgagcgtatctccggctagacagtcgtcaatacaatacctccatacctctgtaggcaaacagtgggccttaattcctaagtacggagacggagtacggagagtacggatttagtgcgcatcatatgcctccattgggtattctcgatgccgccaatcaggcaaccagtggtagcgcgtcaatgagatcatattacaggaagataataatggttataataattaaaaaagagaaaaagaaaaaaagaaaacaaaacaaagacagccaaaaaaagcaaagtgatattaattatagagtcactgaaggaaagtggctctattccagtacaggcatagggatgaataaatgtatacgaacgaaccaattgtaggttagagagtatttgtaggcaatacaggccctacttttccagggcacctagacttcccagagacaaactgcttttgtttttttggtttttttttcccctagttctctcatttcaaggttgtctatagtcttggatatcactccaaaactctccaataatctactgccagaataatcctcaagatcagccaaagagtcagatctttatccccttagtccgttgccaagatgaagtcaaaaaaaccaaaaaagaaaccagcaaaaaaaaaaggaaaaaagaaacgtggtaaccgtgcacattgaagcaacccacgtgagaatataaatatatagaagaaaaagtaaaacgcaaggtgtagccccaaagtccatcccgtttcatccctggacatatcgtgtctcgggccagtcaggtcgaatgaggatcaccctccaagcgaacgtctgcttagcgtgtcccggcctaaatccaataatccatcctaccgtcttggattttgatcatacgccgtaccactttggtgctacatgttagatctgagatccccccgatccgcgactgaccggtctgtcggtgttttagtagttttggctttggttttggttttagcactggtgttttcaagtgtcttaggtatctactatgttaggtatttaggcgttttgactctgttttaatggacttagggtatttgagtacctaggtaggtaattcgaggtttcataaatcccaaagagtgtcaatttgcagtattaccagaggctgaacgtggatccctgaatgcaattaattagaaaaagaaatgaaaataataaaataataaccgggactttgtgcacatggcaggtcgagtctaatggtattcgagcacggactgagttggttatcgcgacggggcttagctgcaaggcccgaaaaaccaattccagctgatcaatggccttaaccttggaagtcctcttctgatatataaatatactggcatccacttggtctcgggtctttagcctcataacgttatcacatccctccgctttcatcttccacttctacatctactatactattccctgttcccatttctatttctatttctattctctattctgtattttatctctctcctcttagcctttacctcttttaaccatgaatcgctctccatcgtatgatggccgttcaggctctcgtggtagtcacagcaacagcagcgcattcagcccaaacgccaacccaaacgaggactggaccaagatctctgacctcgcagagcgtcggcgcatccaaaaccgtatcgcccagcgcaactatcgtaaggaaaaaaaaaaaaaagataaatcccatcctaaggctacatttctgactcggcgcaacccaacaggcaagaaactgaagcgccgcttggaggacctcgagagacgagctgcaacctctgcttcgccagaacaatcacacgcagagccggtgtctcctaagccatcgcccaagactcgaacaaagcgatcctcaaaagtcacagatgtcaaacctcactcgcagtcagaccgagctgcctcgtacgactactattcccccgaggaccgtcaaaccatgttcgcccagcagtgcactcgtcagctctctgcctcgcccccaccagtcttctcatacccgtccatgtcgtcatatgacacctaccggcagtctgcctacccccaatcccccatctaccacacggcaccgagcaactatagtgaagtcgcctatcagaccgaatatggcgagcccgttccctcgctagtccccgtgctcccatcgatgcaatcccgcaaactcgcctatgacgaagacctgatcagtccattcagcatgagctacgcaacaatggccggaatcgacctatgccaacagcaagctcaagcgcagtcccattctcaacatctgccttctgggcttccggtacattttcctcgctgagcctactcaccatgccgaccagtcagctaatatatgcccgcattttcttttcccagatgccatcgcttgcatactacgaggaccagcgagcaccatcgacgtcaccagaggcatctattttcacattcccactcacaccggaatcaggcccatgctcgcctcgttcaatgcatggcctgtatgagtacgatctacggccgtaaggtgaccggaccgggggcgagagagcccggattgcgggtacatatttccgccccatccaggcctgatctcccgaacgtcggattcccagtctatccgccgggttttttcctgttgcctttttccgagttggctctccactctcgatttatttatttatttattttgttttcttattgttttctgtctcttttatttgtgccagcctttccccccccccccctattatgtgtgacgagataactgcatgataactggtgttgattcttctttttattggtagcgtggtgttaagggaacaggggtgagctagggagccacgttgaatggattcttttctttttctttttctttttctatttcttcttgatattttgttttcttttcttctttctttgtctgattcctttctctgttttgattaaacgcagatccagagagtacagttgacggatttggataacaatagaatcctataaccttggaagttctcatagtgattggtccaaatccaacttaacttgcataactccacggcccccaaacccatgcgggattttcaatttcagcttagccaaaaacattttacacggctgaaacgatttcctgttctggagatctcaacggtgattgacgtatgtatttcttttctgaagttccccggtttggtagccctaatatccaaggatgagacatatatatgaaaaccaccagtttcttaaagcggacaagtttatacatgactcaagaatcctaactcaagtgcactgtcaactaaggaccaatctactgggaaaatcccgatccctgcagaaagagacaatacccacaccccacacagcacttctttatcccggtatattgggcccgttcgactaaagcactcgaattggctttgaaaaagattttttgtaaattggcatccactttcagttaattccaataaattcatcggatgatgcaatctgcaatatcctccgtctgccccatcagaatccactatcccggttacatagttgtactatacgcgcagagaggtacggaggtggtccgtgaattgtgctgcgcctcaactctttcccccctcctttcaaagcattctgtactttggtaaaggacaacacattaaccaaggtcccctccaaactaagaaacaccctggagccaagcaaaagacgcctagcatgttggctttttttcccaacagtcgcatccacttcggattggcaatgtttcgcccggctagaataaacagtttacatccgggtcccaaaggtctcggagtaatagcccgcctttgacgcctccaatgattgccatgcaagtccggtggcacggatgctatatgcaataacacaaagaacctcaggaaatcatacctaggtagagtgtacggagtattatgatgcgaaaataaccacccaatatttcgggaatagcctactagcgtaccactccgtactctgtcgttcactgactattagaggattggggctgaaaccgaaaaacaacagctaaataatttaggtagttttattcccgctcaacccacatggcaggggttgaggggcgagagggccagccaatagccttctttttcctatcccagcttagcttggggagagcatcttcttatcagggttggcggctctggtctgcagtgttcccgcctatcccccatccctgactggtgtggatcaaaaatatggagatatgcataaacgaaggagctaacattggccaaaaaggaaggtgttgtataataaaatgattttcctcctcctcttcccaattcccctctttgcacgttgcatgttgcatgttgcagtgattcacccgcattgcccccaaccttatctacggcgcaagccaaaaatgtcaactcggtcaatgttgctgaacgaatttggaatgagggaaatcccgaataagactaaggagagaaaggacacaaaaaaagggtctctcagccttggttagcttggttagcttgctaattgacaattttgatctgctcgccaaggaatacctactccggacaccgtgctccgtacttcgtatacagaggatgatatatccatagtacaacatacatattatcaaccattgcgaggcaaccccagtccgagagtagctccatctaagtaaaacaaccaaaataaacaggaatatgcaactgaaaaagtacagcggaacacagttcctagagctatccactacatatgtgaccagccaagaagccgaacgtgaatccctttggaaggacgattaaacccagcctgtcaccgtctagacccatagggcgccttaagggatatgcgccgtcaaactccacattctgcagcggggctggccgcagtcagcacgggagaccgcagtattgggaacggtaggtctttcagtttctatcttgtatgtcgggagttctttgtatgggcgaataattttaaccttgacaaatgaggaaatcgatgcgacgagtgcatatacctatgtacatggtgagtttggtgcttttggcgcagtacagagtattgtataaatactggttttgtttcctggattctggattgggcctttttgggggccattggtccagatcgttaattgattatggttatggggtaatttccacattggcagtgcgtggcactaattgggcatacattgtacaagattgtggaccatctgccacccgaacctctgataatggaattttgaaacgacggagtattaatgggaggattgaggatttaggctcgggttcttcccgacgggcgaagggagaacgtgcgctcgtcaatatttcccaaacgtggtagatggacaatcctagtgttcttatttacagttcttccaagtgctgatatgctttcggtatggtaattaaaggcttgttttgctcttcctttcctattttacttatttccaaattctgggaccaaaggtcccgaagaagttttatatagtgctttggaagcagcaaatactatctccagtctgctctaaaccgggtgaaattactccgtatactaaagctcattgaactgtaatcctagaagctgaaagaaaccccttttctgtcgatatggcttggctaagagacctctcgggaggaaagccactccagtcgcgttgcccagtagttcacctttgttagaccacagatcacaggatgtcggattggaaagcaaaatacttattctctccccttccctcgtggacctctcttgactttcataatgacattactccttacctacgtaataataagttcccgtacactgtaataaggcgatagtcaaatcaaatcaggaatgattatattgcctgttcaatatatagtatctcacatattaggatgtccaacatatttacaggactatcaaggtatcaagtgccaagacataagaaagattatgcagggcattaaagttaaagatctcaccattcgttcgttcattgatctgtctatcaccttattctcccaaatatagattcataggggccaggataatcagaattgatagctggaaagtgatagaacattagagaggaaaccaatatatagttcattgccaactgtaggtcactgttggagattgatatgctccggtgccaagatctacgcgctgaagattcaggagaaggaagagacaacaaagaacccaagttcaacaactgaaactcactatagcggtttcaaagaaaagagaaaagaacacaggagcgtggcaatataaaagccccctcattcagccaaaaccaaaaccaacacaatgcgctcaaagacccactataccagctccatacgataatgcttgggaatcacaatgcatcaagaaccgcccttggccatggatatgccccatgtgacagtttctagcgttacaccactatctcggcattccaataggataaatcaagtcaaattgtacgcgcccgaccccaataattgaccaggattgggcatgcatatacatatacgctaacagttatacgcagatacgctaaatcctcaatgggattcccaggcggaccgcttacccgccgttccgccagtccgccagtccgccagtctggtgcactatacaagatcgacttagtgtttctttgtaccaatttggattataaattatgtgtgcttttttctccaatgatgataaactatgagtaattatgagggattgttataaatcagattgataacctccgtggaccttggaagtgcacgcaagcaaggtacggcctaatacgagactgttgtcataggtggcacgggcataggtggtgcacctttgacatcggcgtcgccgatgcgttaaggtcttgaatgggacaaggaacgccaacgcatgattgaacggactcgggaacgtgctgtatcggatttggaatgttttagtatttccaataaattgggttacgtcggggacgccggtgtatacgagcccgttgggtgacgttcatatgcagttagaggctcaaaggtggaggctcagcttctacttgcagattgcggtacaccacagtacggagtacctgaggctctgttgctcttatgatgatttgttttttaatatgtggaggtggaggtggacccttgaatgttgggctgctccgtactcattatagacatgggaagtgtgaagcattcgaggggaaagaatagtatggaaagcaatgtatactacttcaccttccattcaaaaaaaaaaaaaaaaataatgataataatgtgctgagtctacggacgaaaaaaaaagaagaagaataaaacaatgaatggagacggattgatcctggtattcgaaacaagaggatcatggaaggaggccagggaagatgcgcgcagacagaatagaagcccaatagattagaagaaaaaaagatagcccattcaaagcagcgagtaaaacaagctcaaacatctgtcatcattgtcatcaattcctgaaccaatcattcgacagccaagggtacggcacagatcttcccatgacacggttgactcaatcttggaaaaaaccacgaatgcaagtcttttttttttacccagcttcatcgaccgtgcacgtccatcggatctgtggagactaaggcgccaaggttttgtcgccggcgccgcatcggggctttcttgcggttcgcaatgacagcatcttgcgtttgttccgcgttcatctcggtatcgccatccttatcgtcgcgtatttcctgtggagacagcccgtgctcgtgattccacgcctcgtcgagctccataacgtttttgggtttcatgcgcagccatttcatacgcgggccgacacgcgagacctcagagaccttgaagccgtagattctggggtcatagatcttgcccttaccgagtccgggacagaggttgggtgtccggaccccgttgatttccagcggctgattttccggcgtgggcgactgtgcctggcgaccagccggggttcgtgtcagggagccagtgcgagactgcgttgatgcactccgtggcgacatcattgacaatgtcgcgtcaaggcggggcccgatatccaaatctgggaatgtcatgaaaaacagacatccgaacgttgtaccgaagaaggcgccgtcaacagagtggaaacggctgttggggggtgtataaatatccatgcaaccggggcagaagagcttgaccgtttcgtggccaggggtgtcggaccggcccacggggagcactttgcatccgttacagttgactcgcggacaggtgccgaaatgctgcatctcatatttttcgagcatctgttgaatgccgggccgcgaagtgatataccgttggtgaatcaacccatacaggagctcggcggagctctcgatcacgctcaaatcgcttgcgactcgggcgtgtcgccggtcgcctgctcttctgtatccaggttggtcaccaccgagcgcatcgtcttcatcttcctcctcctcctcttcctcctcctcttcctcatcatcctccggctccacatcgaggatcatctctagtgcctccttgtacatgggcacctgtgactggagaccagtcagattgaaatcatcctcaatgaagtcctccgacacctctgcgaaaaactcatggcccatcaacgaacaaaacgaggaaatccaggactccggcgctccttccgaggacgacatgtcgaacgaggcggacacagatgacgatagggtcgattcagacagttgactcaaatccagcctgtcgaggccgtcggccaacgccgaacctgtctctctcgacacgttgccgagctggggggtgaggtcttcggggatgttggcgcagacgaagcaatttcgtcacgcggaggtgctggatcgtggcgaggaagagtgtaggagttgggaggtgagaacgaaagacttcaagtataataaatagtaggggatcttgaagttgatggaggggccgaaaagctagacgttcatagcaatgtgcgggaggggggagattgtgcgatcaacggggaagaggttggatctaaggctggaccccaccaaaatcttatcagtttcttatagccttcatactgaaaattatcagatcgcttaccagatctcaaaacactcggagattaatattggcgactcgggcttggaggttgggtgtgtcggtcgaatcgggttaggcccgttcggttcgtgggggcggtgggcagttggatagagagagaggtcttccagggctgttccacgtattgtggcagctattgtgtctgctatatctcacgatggcaaaaagtgaagtcaatgctggcaggtttcaatttgcctgagcggcatgagtcacgtgtcagctgacctggggatatagctacctaacttgaagggctattgatactcatatcttggaagcctcaactaaccaatgctgtcattggtgttattacaacatgtaactatcaaagggtattgactaaatatcaaaacaagtcccgaatgactcgagcaaactctccctcatcacccaaaacccccgataaaccttcgccggtgttctgaatttccccatctggccccacgaagccactaataccatcactcgaagtgttaggcatgaaattaccaaaagcgccaacagcctcaaacaggtttgttaactcttggctcatctggagtccatttagaggactatttccgagttcgttcccaccattcatgggtccatacatagacaggtcttggattggatgtccggcgagcccggccatagccactgcagcacttgaatgaggatcacttgagtctggcccaaaaggacgggcgagaacgccaagtttctcgcctattttccgtaagcccttgattgtcttccataaccgcttggagacgtaggacttggtactgaacccgttgaccaagtcgagcgccatgtaaaattcatcgcggacttgtcggttgaattcgaccggagcatgggacactgctaagaacagcaccgccaatgcagcaactaggaagtagttaaacgttatttgctgtgtccggtaaatatcggacatctggtttagccgagttaggacacggactgtgtctttggctatttccacgacagtctgggcgtggcctcggtcttcggcaatgctggcaggagaatggagcacagggcgatatatcaggatgcgtagctggttcatccgcaggtacaagagaaccctgagccgcctcatgcctctgcttacgttttcgttgtttttaggggagccgacgggatagaacttgagctcgtctggaacttgcttgtaccactgtaggatttggtaatccaggtagccgatttcatcacgacggatgtcagtggtgccttcggagcccaaaccagagtaccagatcttggagctgatccggttgtataggaccatgcagcgcaagtaaggcagcgatgcatcctgtaatttccacatgttagttaataaaggtaactgcatgccaaaagatatgcagccttacaggttctggtaagttcggatcaatatcctcgtcctgaatcacgaaaggtaatcccgttcctagactccatcgtctgtccaagctgtagactgaccagaatagtcgagtgatctcgtcccactgcacctcatctgggaatgatttcaccaaagcatcacggcggtgcaatcccatctctaagcacattcgtgccgccaatccaataagccgataagccatggcgtcatcatctgtatggtaatggtatgtggcctggagtgggacacagagttagagttattgactgtgacagttgaagaggccttgacttaccacaatagcaaagagctggatagttttgatggtatgagactcccataactttgattctataaatggcttaacatccaagtagagccgctgcccaagttcactttgaccgcccccttccacgaccagcgtggttgcgagaatcaatttaagaataatcgagctttcatcgtggagaccatcacagcctggaaagccccgttgcgcaaagcctgtcctggtagcagcctctatgaatgtgtagagcagattagtctgggtggtaaccttggcgatatccaccacaggatacatgatcccaatctcttcctcgtaaaccttacaaagacgcattgcctcttcacgcggaatcgtccatattggatccttggtagggtgtgtgattggaagaagctgtcccagattgggagctggggagccagttggagaaacatgtgcggtggtcaagtcgtctgggattccatcttccgctggggtaatacccatattctgtaagctggatttggccacgtcaaaattgaaggccgagcttgttggaccatggaagcgtgggtgacgggctcggggctttgctagaccagcttgcattggagtgtagaccgattgagacccatcgcgcgagagatgctcaaaccctggtgactcaaaagctggtctttgggtacgaaggtcattgagattggtgaacaagctattgacttgctcttgtaaagtggtgatctgatctgtcatcgaccggaactcactagctcggctattagtgtcaagtgccggacgggttttattccttgacttactccgaatctttgaagttgttattacaacaattaggcgcatagcgacctggggattgggtcagctcgaaaccgaggatcggacagctcggacacaggagttgcaagccgccagcagggttaaaagccacttacattccaaattcaggtgaccacaccgttgacaaggcatctggccattgcacttgatcttgcgccgcttgcattcattactgaaaactccatggttagcgctgatcttcctacaaaggtaccgaaggagaaggcataatcatatgactttgaatgcaaaacaggttatccgaccagtcgcaagactggagggctaatcaaccgaggtaacggaaagcagaaaaagtgccggatcaggccatatcgtaccatgcaatggagatgtagcgattccgctttgtgcgcgcctgtgttccgttgccttgttccgcctttctcttgttggaatcggacgcaccgatggactgatcgcgggggtctggttgcggcggcgacatctctagctgaggtgactctgaagccatgacctgcagaatattggagcgattcaatgagtagccggagagagataccggcgtcgaagtgcggagaaattcctctctcgcggggtttccccagattcggcttactcatctgatcatccggccggtcattggccccggggcacatttacaaatggagaatatatgtactcatggatatgatcataatttgttatatggcacagatttctcgctcaggatatattgccccaatcccaatgatacaagtctcgaataaacccgaaagaaaagatatatcagcgcaattacctaactgctgagaccaaccactctttcccagccagcaatgactgcaccaaccgagccctttgttcaggattctggtgtaggaagccaaaggcagcaacgagaccaagaatgacagatccctggagtgttttccgggcacctcgcaaaacccgcccctttctcgtgagtcgcgcagtccaatgccgccacacggggaacgtgcaacgcagccaatagtgaatctgagtgaatctgaatactatgtcagtaacaatcaggaaccagcaagcagggaacgcacggatatgtggttgaattccaaccatcggcagtgatgtaccagctagagcacgccccacgacggaacacactctgctgaagcgcatcctgcacctgctgagtccatacacgctcagcatcctcctttacttcatacgagctaacctgtccattcaagatcggcttgataaacttcaaagagtagtttactgcattctccgtggcgaaaataacactggtgtgccctgttgccgtgttcggaccgaaaagaataaagaagtttgggaaagaatccattgcgatgccctggtatgcctgggcgcctccgcgctccgcccagacctcttcaagatccctgctctccctgccaatcacctttagcgggtgcagccattggttggtttcgaagccattggccatgatgatcacatcggcgggaatctccctggcctcaacggcgtcgtccgacttgtggggtggatagtggcggcccggaccaagagtcacgctcttcgcattgacccttgtcagaggctgggtagtcagttccacatttggggcattgagactgcgataccaggtgccgtcgatgatccgtcgtttacagccgaggctgtagttcggcgtcaagatctcgtggtattcctctggcgcaagttggcgcatgtgatccaaaaacttcttctctagttgcggtcgagctcttcggccccatacagtgtctgtgaacatctcgtagaaacttttctccagcatgaagaaagcaactcttcgtatgaatgacgccagtccaggcacatgggtcatgagtgtaggcgaccatttctcgtacaaggggagatatttgggagggattatatcaggctggacccacggaggagtccgcatgagttgagtaatagatcgaacattggcctctggcctggccagctcgggcactacctgcgcggcgctgcagccggaaccaaccatgatgacattcttgtcctccaaatcaatctggtcgttccagcgagccgtatgcatgatattacctccgaagtcctcaatacctgggatgtccttcggccatgtcttaggttctaccaacccgccgacaccactgacgaccaccttggctcgcacagtttctgtctttacatagattttgtgatgaccttcctgggctgcaattcgatctcgttcgtgctgagctagatcgccggttccagggacaaggtgcgaaagcgtaacctcccattcctcgtcatcctcgatccatcgaagttccttcacatccgtattcagctgaatcttgtccacaatttgatatctctcgcagacatctgccatatactgtgcgagttctggaccagatggatggagtgtggaccagtcctttttctgagcaaaggagaaggaatagaatgtcgctggtctttaccttcggtgttagttatttagtaaacaagcttttgacttgggccacctacatgtcgcaagcagctcccggatacctattgatccaccaggtacctccaataccggactgacgctcgaatattcggaactggtctgtccccagaacctctttgagccggcagcccatggcaacccccgactctccagcacctactatgagaaccgggtaataagtgtgtgcatccttgctgtaagcatggcgcttatgaattcgggcgatggaagaaggcatgttgcacgttaacagtaattacaggcaacacaatgacggtgagacctgggacatgttaatattgacgtggacacccaacgtggcacgaaatgtaagtgtatcttgctaggaaaatacaagttacataaacggcctttcgccaggtgtcttcgacgcgcaaaggtacatatgtatgatgtagcttctcacaactgcgggggatgcctatcgacctcggcttcacgtacggagtaacttcattgtgatcgacaagtggggtaatactcctacataaatgactcgtgattggatccttttcagagaatggttagaggggaaataatacgcaggggaaattgcttggtgacatactaacgcttgtgcttcagtagggttcgcagcctagggttcgcagcctggggcaccagctaaaaatccagtgtgcggactccatctatgatatggagggtctgagggatctggtccaagcagaggaacaggttcaatatcaataagctgcgtaggccaatgaactacgccatcgtagtatatggatttcaccagatcccgctccacgggccaaccctgcactgggggaaactggaccaatctgtagaagccataaacagcgtcttccaattccacttgcgtatggggtttgcatgctcgcagaggaccacatatatgcctaggtggaatgaggtcagtttctgtccctgaatcggtagctcatgccacctacatagtctgggaatcagtatcgtaaatgagcttttgatacctcggatgtctttagggctcccgccttccccaccgccttagccttctgtctttcccaatggcgttttggtagtcttttcggtaccttgtccactactcttttactcttttttgtggtcttttagatgtcttcttcgatcttttcttatagagtagactttatgttgaaaccaggcgatttatgaatatgaaaacaataaaacccatgccccggtatacgtactattactcttttctgccggagcaaaagccggtttatcatcgtgatcttcttgtagtcgcctcctttcaactccccacgtcgatctggatgaagctacagccatggtcaatccgtgtcagggcaggactcccccgttcatccctccattataaaccccgatcaagtatccgaaccctttccgctccttcacaccctcaataccgaccactcggcatcctcgaaaatgccaccctggacaccttccaacagcgttgcttcctccctgaacaaccagcaattctcccacgctctaccttccaaggtctcccggccctgaaacaatggttcaaaagcgcgagtccgcagtcaacactaggcaccttaagcttgaacctggaatatctccacaaacacggcgccgacgcgttcgtcccactcgagctcacggaatccacgtcgacagacactacatccgaaccggacgacagggcaacagaaatccatagcttccggcagttccacgcgccgctcacgctgttcctcgactggatgcgcacggccgagtccactccccaatcaacacgactatacctagcccaatgccagcttcttgacctccctcccgtccttcgagctgatttcccgacgccggagcttgtggtgcgcgcgggaaagggcgatgtatacgatacgaatgtgtggattggacacccgcccacttatacgccactccaccgtgacccgaacccgaacatctttgtccagctggctggggagaaggttgtgcggctgcttgcgccgacggatggacaggctgtgtttggtgctgtgaggaggcagctagggaagagtgggagtcgggaagcagcggctttccggggtgaggagatgatgcaagggagggagagagcgttgttagatgagatggtttgggggactccggtttctgctggttcggatgctggggttggctttgaagcgtgccttgggcctagtgatgggctgttcattcccaggggatggtggcatagtattaagggagttggtggaggtgttacggcttcggtaagtatgtttaattcgtaggcttcgtgtctgtcgctgatatgcttgcaggtcaattggtggtttcgatagtataacatctacgaccgtatcaatgcggcatgcccgcgcttagaacgccaatgcccggtcgacctaggctagatcaattcgaatgctctctgtgacatgttaggcgaaaatccggagaatttgggctatatgcttggaacggccgtggagatcttcaatgttcccggcaaggtcttccaagctttgaaaccgctgggaacatatgcaaatcatcggtgatgccaaatactcgtttacagactaaatacctttacgttatatatggaggacaggctggggagattttgttctagcagactcacgattgtgactgacccgtggtcacacccaaggcctctcaactgtgtaagctcggtgtcacagacaaaatcgaagatgatatacccagcgtataacaatttgagtaatcattaattgtgtagacataaccgataacaatacaaagcgcaacgcggagaatgcggtgtaacgatagaatcgaagtgccgaagtgttgactctagaaacctgcaatccttatcttcctccatcaaatccacctagcctcctccgaaaccccgaaccatgcaagtatcgcgcacagtctaccgcgccgctctcctccacttatccgtcaatcccttcgtgcgcgcctcagtccccgctggtactaccgctacctgggcatccctcaacccggcaatccaagcaccgaacacccggctctacaacatcctcttcccgcagtgcacaacaaccttcaaagcatcggactgcgcgcgccaaacacgtacaatgtgtgactcaagttcgaactccggctccgcatcctcagaccctgcagcccaaaatgcagacacccaaaaccaagagacccaagaccaagaaccccaaccccaaaagaaactctacctccccgccagcgacccctcaaatcccgtcgcgaaccaacaaggcgacgggggcattgaaatcgacatgagcggaggcgggacagaagtgaaactggatcatctgggtccgatggttgttaacgtggacgggacgttgtcgcagatcgggaactggcagcagatgacggagattgagaagactaatactctgcgcgttcttgggaagcggaatcagaagcggttggaagcattgagggctaaggagaaggcggagggagggtcgggtgaagcttgattgtgtataaaaacatccgacgcggagagctcgacctggcctggattcgtgtgtgttgatggaggatgtgactctccttactgttgatgtatgttgatattgcatatatgtattataacaggcattgttacatccatggatgtggatgtcgttagatgtcaagtacgactaataatcgcggctattgtttcaaaacagtattttccaataaccacagagcattgattgggtatcatagtgatgctaacaccatataaacatatgcagtctacagtccaaagtagagacaaaccaccgcccaatgaatcacgtatccacaggtctgcatcggaagtcagctgggtgcgttctgatcgtaagtatatcgcaattagccaaaacaacgatgagacccatgaaaatcttattcaaatataatttggcaccacttgtgcacgaccgttctatgggcattgttagcaccgaatcataactaggaagagagggtatactcacttcggcggtatgaccacaaagtctctagtatactcctcgatctcagggacaccagtgaccagatcgacctcctcgggcttgaggagcttggtcccgtggaacaatttccacccgaaatagataacggggaagacgccgatcatggtgtaggagaagaggaatgtcgggatggaccagttgccaggaaggaagacagtgtagccaccgacgaaagccatgagcgtagtgcttgcgcaagcgaagtaggcgatgtacggctggaaccagctgcggtatggcaaagtttcccgggcaatgccttgggccgcgagagctttcttgaaacggatgaaggtgaaagtgacgacggagaagttgatgagctgggaggcggtgacctggatttagggttagttggatgtatggaaaaggaattgggactgggactgggactggggtggaggtgggggctcataccagattgacaaaccagtttaacacgaccgatgcgccgttagatacctgcaggaaactcaagaggccgatgatgagcactatgccgacacagtagacgggaacaccactgttggtgcacttggtaaggaacctcggggctttgccctcaagcgctaaaccgtacagactgcgactggcacagtacatgtaactgttgcccgcgctgaagcaagcagttaaaatgacagcgttgacgatgtctggcaggattgggattttcaagcgatccatggagatgacatagggcgaggcagcagcaccgggcttgccgttatcgaaagcatcggccatggtcttgtcgttgtacgggaccagaatgccgacgcagaggacacctagaacgaagaatgctgtgagacggtagaagacaccgttgaaggccttgggcagcaccttgcgcgggttaatggtctcgccagcggccatggagacatagtccggaccggcgatggtgaaactggctgtgatgacacctgcgaggacacctaggaacttgccagtatcacctgtcttatagtactcgttgaaggcacctggttcgttccaataacggaagccaaaccgatcgccgagcgggttgccgcccaacatgacgatgaatgtgtagaagatgaggcctatgctgagcaagaccttgcccagtgaaagccagaactctgcttcaccgtaccatttcacagcaaagagattgagtgctctgtttcctattaattagcccgtatctcgtgcgcgcattgaataagacgacaaacccatagagtataatgataaccacattcatggctgcgacgggaatcacatcggtccagtatctaataatcaagctgacggcgacaatctcgaatggcaccagtgccgcctcaaaaataaagaagttgtatccagcggcaacgcctaaagcttcatcaacgtagcggccggcgaatcggatgaacggcgatgagataggtaggtacgtgaccatttcagccaagcctagaaacgaaaatgtgagtctggatatcatactacgcaaccggatggaaaaaataagacggaggaatattgcagcgattgggcgatcggttgacattacggcaagctgaaccgttggcgcatttgggatcgtaaggggtatagtttcaggtatgaaggaatgctgctgctgggaaagatgcaaagggcttgggaagcatgggggtgttcgtacagacggtgatgatcaaaatcacacaactcctagagaacagtataagattgtggacgttcaatgagctatacacagaaaccaggcaagggcatcatggactgggtttagtccttgggtgtccggctggctttcggcagatgcatgggcagaagtagggctaatggcgactttggtcgacattcataatctggttggcatggaagtgcttgggctaacagcgtcctacatccttggtctgaaattgtggaatcaggcttcgagccttgtttctcgatgctttgtttgtttgggtggttccttattctttgcttctttgcctctttgcctctcttttcttgatccaatggcgggcttattttccgtttctggtattaccgcctacttaccgtccatgttgatgctgtcgaaagtggcgaagtcgggacaacccaggtcgagaacccaatagagtcaacaaaacagtataacaggggaaagactaaccaaagactgaatccaatgaacaaactggcagggccactggtccgcagtccagatccgatctgaacgtatagagctgtaccaattgttcctccaattccgatcaattgtacatggcggggtttaagcttgcgatgagtatggtcatacgtggatttcatcgatccgctatcgaccgaggtcgcgcgattggcgctggatgagtctttctcggtgacttctatttctttgtccatcttggtaggcttcgattcggggtcagagaggaggatgggctctgcgctctgtatggctgccgccatcggggtatggctctcataccccgagttaggaggatgcgacatcttgaaggtctccttgtaagctccacgaaagagcaaaggaatagcacaaacaattgcgcaaaagagtccagaccgagatttctttcaaaggaaatgtaaggaatgcagacaagagagaggcgacaggaatcaggaatgagagtttttcctttttccttttttttttttttttttttttgcctagctgagtagtattttcctgtttcgagttagtgggatttgttaaaatcttctgaaaaggcaatcggcgtcggccgaactaaaggaaagtccagacaaggaacaaatcagagagtcggcccaagagtgtctgatgttcatccattttatccccacatggcccctcctaaggggaagcgagggggaattggggctgacctgatcactctgtgcgcccattggattggatacttcggtctgtatagggggctctcaatcaagagagtattgttcgcagtgatcatacgatacaactggcaatgtcagaaagtgctggccaatgtatcatgtatcttctgagtgtttatgttgtaggtagattataataagtccccgcagctatcccgtgtggagagatttattgccgaggtccattgggggaatggagacttttcaccaactccaaggcattcgcaagagtaacttaagccccaagtctgaatatctgaatatctgaacacatggatacatgtatacaatatacataactaagtacagctgttatattaaacatgaatccctgtaattaacacacgccacattccactattctcatgtgcttcccttgtaggcactagtgctagtgtccctagtgccctcgaagttgttgccacccgagttttcggtggagagtctctgctgtgagtctttcccgatccaacttggtgggaagaagccgtcgttgtcttcaaaatagaggtgatggatcacatcagagtctgtggagttccggcgttgatccgggtcttgatgcggatgttcggtagtagaacttggatgtggatgcgtgccggggaacgacatatcgaataatagtattttactgtgttactggagatgtgttaaagaaagcaatcaaacgcctgagcagttgacgttgtagaactctcccaaggtcaggtgcaagctctcggtcaatatcctgacgtcatgagatacatcatatcagcactcttactgtatacgagggctaaccggattgaggcaaaaagagagaagctttgtaaatatcggaaggtaccaatcccgaataagcagtcgatcacagtatttgatggggtaataatctggaaaggatatattgttcgtattaggaccgaaatatcaaggttaaccatataaccccatttagagtgtatagaagaggaatgtaaatcgttctaaatgtatatagggttcaagcagcatacatatgtaagaatgtagctaagtacatacaatacctaggtatatgtgtatgtagattaaccggtcaatcagacagccgacaagtaagcagccctgaagctcgggctacctcgggataccccgccaaccctcaagatgtttttttttccctctacttcacctccaacaatcacaatggtcgaacaaacaggagaatctaagcgcttcgaacccaaagtggcagtccagcttgacccgcctaaggacgacctcatttctgtcgaggaattggccaaatgcgacggtatgagagtttacccttcacagattagaaccccaccaattcctgatttccaatccgctcagctcaaagagtgtcactaatacctactgcactgcaggtaccgatcctaaccgcccgactctagtcgccatcaaaggtgttgtcttcgatgtgacccggaattcggcttatggtgcctcgggttcataccgcggtgagtacagcatctattctatgaacagtataatgacaacaatactgactgttgtgttctcttagtcttcgccggcaaggatgcctcccgtgctcttgcttcatcctctctcaagcccgaagactgtgtaccggagtggtatgatctgccggacaaggaaaagaccgtcttggatgagtggtacaccttcttcagcaagcggtataacattgtcggcaaggttgaaggcgccaagaacacctaagggctacattatcatcgagcggcagctttcacctggatcaaatatgcggcattatatacccaatgagaaatggatcaacgacccagtatcgaatatcaaatccatgcttttcattttcgaaatggtggtatcgcgtaggtacaaagaacagttcttccctctgactgctgggataaataatgtctatacattaaaaagtaacatgtaacatttatgcctttaattccccttacgggacttccgcttcatgcgcttctgtccgataatgcggttgcgcttggcggccttgtcctcctcttcactcttcccatctttgggaccctttccattttcagtcttgccacgcttcacgtcccttccatcctttcctttcccaccacgagtatcggagcgcttcctcttctgacctctgtctccctcaccctcagcatcatccgagcgcttgggcttgggttcgcgggacttagcttgcagctcattacggcgcttaacaacctgggcattctcaatggcaaactcaacaacgaggctcttcttcttgtccctgtcttcgggatcttgggcagaaggaggaactgtcatggagtggcagttcagccagcgcaaactcatcagcgcgtgacggtgggtgaagaactcgatgaatccgtagccacgactgcgaccgccaccgcttttctcggagaccttggtaccctcgcgagtctcgaagacgaccttggcctggcgcacaatacccatcttcttctgtttgcggagctgctctagctccttcatcgtgtcgcgggatcgctgctgctcctcttttgagagcggctggcgcgtgcccgccttgacgtccttggcgaaattgacgacggactctcgggcaagttgtttcaagtccttggagttgatgtggcggggaaggttgcgaatggcgagacgggtaagactgaggtggagagctgggtttttcttgatgaaggtctcgcgctgcttgtagctgtcctcgcgcatcttcacttcggagggagagagcttcttgtacagcggggagttggagggaatcgtaccctcgctgaggaggtacagacggcgcttgtctgtgtcacggaccatacggcgtgatactccctcctcttccaacttggcggcttgacccttactcacggcccgtgcgacctgcaggacgcggccttccagggtgtagcggccgcttgggtcggagttttcatcttggagaacggagtgcttcatagcggtgtttgacttgggcttgtctttgttcggtgccatagcttcagctcctcggggggcttcacgaatgcatgtgttggcgtcgtcgggcttccagaagcagacgaatccagtacctcgggggcgctcagtttcgtagtcaaggactacacgtgcgtaccgtagcggtccaaagtgggttttgaagtgatcgtatagtacctggtctgtggcggtgaatgggaggttgcgaatgaagattgtagtggcgtttcgctcatcctcctcctctgcctcgtcatcgtccaaatcgtctagctcgtccaagtcctcgtcctcctcatcgtcgtcttcgtcggaagaggtctcgtcgtctgagggctcttccagagcaccctcggcatcttccatgtcaacatcatcagactccttctcttccttcggctcctcgtcttcctcctcgttatcttccttcttggttgtttcccagacgtctttttcaacagcccaatcaacggcgagttgacgcccatcgatctcctttccgttgatcatctggagtgccctctcggcgttctttctgccacgcatggtaatgaaaccgaaacctgaaagtttgccattcctcttgggtagagtagcaaacttgacttttccaaagctgcggaacaggacgttcagatcctcaggctccttgatactccacggcaggttgcgaacaatcagcttgggcggcaggccctgccctctctcctcttccttctgtttcttggactcccgggaggcagcagtggggacactacgtccaaccttctcgtcaatctcacgcttacgagactcggcatagtcaacgcgaatgactttcccgtcgaacttggacccgttgagttctttcagagcgctctccgcatcctcgacgtcggcgaatgtaacaaaaccgaatcctttggacgcctttgtctctttgtcgcaaaccacaacagcatgcttgataatgtatgattgcgagaaatattctgcgagactttctgtcgtggctgaggtgggtagtgagcggacgaaaagagttctcttgttctgtgcggccgaggcctcggcggcgggtgtagtggtctcaactttgatttccgggctctcagtgtcggagaggcgtcgtttcttgtgtgattcgtccatggtggttttgttgcgactgcggttttttttttcctgcggtcgaggaagaacaaaaaaattagcggcagaaaactgagccagattggcccgggcggtgtgggtctcacatccagataagccatagttagtagctttatcgatttatcgactcttagttgatcgctctgcatttagcaacagaacattgataggcgcgatggatcccccgcgtccagagagtggcatacctgctcgccctacgaactctcctgctccaggtgcatcttcaagatctaaagtccaacagccgaaaccccaaaccctcgtcaaccgccctggtacttccgcgatcttggtgtccacacgacaaaaggggaacccaatactgacccatataaaactcctaccatgggagtatgctgatattcccgcggactatgtggtcggcactacaacgtgcgcaatgtttctctctttgaaataccatcgcctacaccccgaatacatctactcccgagtgaaacaactagcaggcaaatacaacctccgccttgtactggtgatggttgacataccaaatcacgaagacagtcttagagagctttcgaaaacatccattatcaacaatctgaccttgatattgtgttggtccgcaccagaggctgcacattatctcgagctctacaagtcctcagagaacgcacagcccactgccattcgagcgcaacaggcccaatcctataaggagtcactagttgagtttgtcacagtccccagaagtatcaacaagtccgacgccgcgagtttgatctccactttcggcagcttgcaaaatgccatcaatgcacagcccgaacagatcagcgctgtgccgggatggggagaaaagaaggtcctacaatggtgccatgcggtccgggaagactttagagtcgagagtacgaagagggccgctgctcctgccacacaacgccgggctcaactgccaggcgtgaacgttgaggacatacacgatcagaacatgggtgaagaggatgaagaagaggcgattcttcgtgaagtactagccgaaagcaggaaaacagcagctgcgcaagctgtgcaagctgcgccccctactgagtctcaggctggccagcaaactgaagagatgagtgaaggtattgcagcggccattgccaggctcagagacaatgctggttgagagccgaatctgactcctcttcactatatctacttttgagccttcagcttctagagatgaacctcattgtcacctacgtgactactgagtagggtacttcttacttgggaaggaacatcatccgctggtcgtcaggacgcggggacgtaatggcattcttgtcgacggctgtcaaagcttgaatgatctgggagacctcatgttcatgataaattccccatggccgggacatggatctagctcacgaaagccacccaccccaacacatgaccccagctaggggtatatctccatttctacggcttcagggaactgacccttccggcgtggctgagcatgattctttttgcaatgcccaagaattcatcccaacatactccgtacatgactctcacatcccttgttatgaaaatcctttttgggggtcaggctaggatctttcttgtggtttccttattgtttgcggcctcgctgcctttccctcgcgggacctgtttacttctctttatctgaatactctttctgtaccattgtatttacatatattgataaaatcattggtttcaagtgcatctgttgctactgctacattccgaacatcgctcttcatatgccatccataaatgtttcgcggggttataaaatttcgcccactccttccaaaaagcttgattacgctcgtctcctagatattcttaagctttgctaggcattgctgtttgcgtgttcactcggaatctaggtgaaatccgagtagccaaaaattcgccagttggattccagccttggccctacccgccaatacaatagctgactaaccaggtgcttactcatcagggacgtcgacgaggtcgtgggcttcatctcaccatttgataagtatgcattctccgcgctgaggtatctaggcgcaagccaaatatagaatgccaatcgacatgtcgattcactcgggccattcaaacagtcgctcaagggtcctcccaaggtccaagctaggatgcaaaacttgcaagtaggtgcttccaaggttgcttccttttccatagtcagagtttgatatcgagcgtattgtagaatccgacgagtcaagtgtggagaagagaagcctagctgcgtccgatgtaccagtacaggtcgcaagtgtgactttgaagaagtaaggccctcttccacaatctcggtcatcgccaaccccttatcattatcgccaaacaccaatgcagtgtggcgagagcgacgtgcatttgcctattattttgagtgtgctgcctcctctattggtggtggattggatgttgatttctggcgcactgttgtcccacaggtttgccgctacgaacctgctgtttgggatgccatcatcaccattagtacgctatttgagagccctcagcaatgcccagatcctgtgctccaacgccgcgataatattatttctctcactaaaaaccgtcaagacgccttgcactggtactcgcgctcggtatctgctattcgccagcgcatcgagcagggtagtgtagacgtctttgtcggattgatcagttgtgtgctttttatctgcattgaggccatcgagggaaatgcagacggcgcaatgcagctttactatcaaggcgtgcagctcattaacgctttgcgtccccaaatagcatctggggccgcgagcaaagcttccctgttggaggatactattatccctatctttatccgtttggggacattcgcactcgccagtggtggggctcctgtgactgctttactccgaggcagtgaacatgccttgacggaacggttcgactcgctcaagcctgctcgggaagcgattgtgctcttatctatagagatcccgctctttgaacgcagttacgccaagcacctacttcaggctcaggtccctcatttgcccgaagagctcaatactgagctattttgtctggtcaccagactgagaaactggcgtactgcgtttgataagttgatgacagttcttcgcgccagacaccttttatcgctgcaagagattggtatctgtgcccatttgttgacttatcatgaaatgttacatgtcatgctggagacctgcacatcattgtcgttgatgcaattcgatgcttatctaccaagcttccaaaacattgttgaacaatctgccattgcatccaaagcctcagtgcgatcagatggcacccaaccaccattcacatttgacgtcaacattggtcttccgctttggttcaccagtcttcgatgccgtgaaccacgcacccggcgcgcagccctagccctactccgtcaagcgccctttgtgcaaggattttaccagtgctccatatgggcaaccgtgggccaaacaatcatggacctggaagaatcatacgcaatgggaatgaatgcagcccataatgcccccgaccccgattatagtctacttgaatcaacaaacggaccaattcccagctccgaacttgccgcaagctcatactctgctcatgctgatatggaaccgagaataccaaccgcactgtttatcccagaggaggtgcgcatcggacccatttctgcttttcggccgatagatgggtttcctcctggaaccacagaggcagatatcgcgaagtggaaccggggccctgatcagttcttcctacggatttcccgaaaggagcgctgtctgactggaaatgcttgtccgatggtgtatgaatgtgttccccttgacttttgatcatagtattaatccgggtggatattgatcaacttgatgtagagagttcgcacttgtgtggcaactgggctttagtattctccaatctctagcattgcttcaagtaatcttccttgggtttttcatacggcgtacatttatggagcaagatagttcagctcagctctgaatgtcccatcctttggggaataacaaggaaactgcggtagtaaaagtaaaatgtagtacaattcagctaccacttcgttgggtagtttcttcctgcagaccgtttggtctcaagattttcatgatgaaagtagttagaacgatcaactctcgatagtgatagtggttgtatatgctgcgtagagtccaaaagtttccattgaggtgcgatttttgttgagatatgtgtgcagctttgattgtctgcatgttggcctgatttatcaagccaggctcctaagtagcacatatactggctatttgttgaaatccggtcaccactacctacatacatacgcgtacatacttccgtggtgacagtcgctctttctcttttctcttcgctctttcctcttccttttccctctgttgtttatcatcaccttgggcacggtacatacatggacggcaaggtggctagacatgtctgattctcagtcaatctggcttcgtcggtttctgtctttctgatccttacgcatacatctattccttgattttgtgtcgttcattccctcccctcatcgttatgatgacttgtaacctggacgtctccaaccaggatgcctcgttgtgacttcatacaagttcaacgaagtctgagcaacgtgagatattattacaccatacacgctgagttcgtcaatcaccatgtacttttggctcctcacaaagcccgacttcaagtggctcaaataaacgtggttgtgtccgatgaagtcgttaaagaaatttggatctctgtcgttggttgaacgatatgaggtattgcacagccacgagcagcaccacggttgaaaagaaacctgttcgggaggagcaacaaaggcaagtactgcaacattaccgaatgtggttattctcgtgctaagtgtaaataagtccaatggagccattgcaactgacggctcattcgaacctacgtcacacgcccagctgcccattgcgtcgccgctcgccattgggtacacaaggcagtttacaacaatataaatattcgacttccgacctttggagaacctgatcgattctaaatccttcgtgcctaccaatatcctggttggcaaccctatataaagtactttgcaagattggtagaaaaggtggcccgagaactgaagagttgacaatggtaggtcttgaactctacagggttgagccgaaaaccaggtatatctatttgatagaatcctacatgcttcacctctagcaacatctcgcaacataatgtgagagatggaccctgtcgcaaatgagtctacatagtcaagcacttctcttcgtatggccttgatcggatgacagtgccttccctttcaacttgctcctgccatctagtttccttttttatttttcaacctcatcgcactcgatttcaacccacaatcttaatttcaccttcatcgatctaaaccatacacctctcgctatcattcccaatcatcccccaggatggatgaagcaactatggtaggtcccggcagaagtcgcttggctaactctcacatatcggtcacttcaagataaatgctaattcatctctaataatttctagaaagaccagcgtttcgagttgatcgaacgagacacaatgttggctttgcgtgaagctcgtcttcaagcgactctccagtctaacaggaatgccatacatgctacccgaaacaaactccgacctttactggctcttagcgaccaacagccccgatacttgaactcgaaaatcgaacaattggaggctcttttggaggaattgatgacccagcgcgcccagttgggcagtgattgcgaccacattcgtgctcagcgctcagatatcgcagggttcattcgtgagctgcctagctctcagaattgaccgattaccccgaggcagtcaacgatccaatttcagttacttatcaaagtcctttctcgttctagcctttctcctagtatggtacggtaagatagattatggaaatgttgtatgataccgcaagctttgcgatataagcttagtagagctcttaacttttttggtagctagcaaattgtagaaaggatttcgctctgcacctgtcggatcttctagactgtcgtagtgcttcgaaatgcctttccaatggatttgctcgttcatctaactctcttttatcgttcccagcgcatcccgcttaactctacctggaatgatacatgcacatgaatcgacgccatcttgcctttcacttaagcaacatatctacaatctcacctcctcccctagcaatggaccaagtacgtgtcgtgtgcgcccgctaaagtcctttggattttaagccctcatatatcaatatatgtgggatgaatacttatatagatccgagaattgccagagagactaatatgcagggttagtcgcacgcaacgcattattgcctttgtgagccgatgtggagctaaacctaatagccaccgattctgtcaaggtcggacagtactcgctaaagaatataatcccgttgtggaattttcaatcaatggaaagctgtcagggaagagtcatgggctcagggaatccggctaggagatgaacattatcacatatgaaatgtgaatgcgcataaacaaatacagaactatgttgactagctcagccgatgatcgtcatttgtctgcgtgactgatcctcttgaaaactgtactttccgaagaacacagtcaacactccagccaatgggctagtcgaagcttgtggagagatcacaaaaggatcggcatgtaactgagaaaaaggaaaatacaaggtgagattccattctcacttacacgcagtttggccagtagcttcatagattggtcaattcttcacctggtctatatgcctagtcatgtctcgggcaagagaagcgagggtacatattgagggtgtgggggaaacgatacgtgatgaaatcctagcttgagcatggaaatcctccaatttaggttctcctgccttcttatttaatcatgcagctttctctgataggatacgaataatttagcagtggacctctctgcaaagtgcgtgatcgacaagcaaaagtggcgtgggccggcccacgaatgcacgagcacacaggatctgatcttctttttttctgtttaccgccagtggagagtgctctgagaatcagatctccacatatccaggaacggcccctgcagtgcttgactagttacttttcagttagtcactggtaaaaatacgaaatccgatttcggtgcctatttactataagggcaatgattccttatgtgtccacgtgtggtccaacctgatttagcccgctggacagctgttgaattctacagtcaactatcatgggtattcgccctttgatccgaagagcacgtgtcgtgttccgccgcatgtcgactgaagacaatgacagtggctccctcacacagaacacggcccggaatggtaaagatggccctccaagtcccgtcagctctgtggcgctcgaggagataccagacgggaatgcccaacatggtgtgcaagatgtcgaggccgtgaccatgacgtggacgaggggtatgttgatcgcatttttcatcaagtatgttcccagtcactgtattttgtgttgcgcatccaattccatcatctatttccgacagacgctgacatcatgacccaatagcatttggttcctttactttgcgaatgcgtttcaatctactgttatcgttactctgaacccctatgtgacaagttcattcacagcacactcgctgtccggggttcccacagccctaggtgatgtctttgcagccgccacctacctacctgtcgcaaagatgatggatgtatggggccgtgccgaagggtttctcttgatggtcatatgtttaaccatcggcttggttctcatggcgacatgtgatagctttgggatctactgcgccgccaacgtgagttccaaggaagacatgctgcttactacgtatactgacggaaatataaggtcttctactataccggtttctacggtatggaatacgcagtcgatgttatgacagccgacgtctcaaccctgaggaaccgtgcttttgcctatgcgtttacttcctccccatacattatcacggcatttgcgggaccaaaggtggcaaacgaattttacgaccaggtttcttggcaatggggatttggctgctgggcaatcattgttcctgtggtggcggctccgctatacataatgctgaagtacaacttgtataaggcggagaaagaaggctaccggatcaagagaccaagtggtcgcacggtagttgaaagcatccgtcactggactatcgagtttgatggtaagtactctacttgctgatttctatcctccacgagagaaagcaaaatctaatttagaacactagttcttggagtcttcttgttcactgttggtcttgtgttgtttgagcttcccttcgacctcgcacattacgcccctgataattgggcttctggctacattattgccatgcttgtcgtcgggttctgtatgctctttgtcttcgctatttgggaagggtggctagctccagtgcctctttttgaatggcgacttcttacgaaccgcactattcttggtgcagtccttttggatgcaacctaccagctctcaaactattgctggagttactacttcacatcctggctgcaagttaacaatgacctatccattaccacctccaactatatcgtcaatatcttcgatatggtctcaggtgtgctattgctagccaccggttggctaatccggagagtcggccgttataagtggactctgtatattgctattccactctatatcttcgcacagggattgatgatatacttccgtcagcctaatgtgaatgttggctatcaagtgatgtgccagatcttcctcgctatcggtggttctacctttattcttgtcgagcagcttgctattctagcggctgtcgaccaccaacacgtcgccacagcgctcgctgtgttgaacgtggttggcactattggcgatagtgcgggtcttactatcagtaccgtcatctggcaaaacacatacctgaaagctcttcttcgatacctcccggaatcggcgtcgctaaatttgaacaaaatctacgaggatctcgtcacacaacggagctatccggtcggaacccccaccaggctggctattcagaaagcctacgcctatgccgaacttcgactactttctgttggttgtggcattataattctcgcgattccttggacattcatgatgaaagatatcaatttgaagaggaagccacaagtcagaggtacagtcttttaggatgacaacaagtataagataatacctaggtatagaaatttacgcggctcagaatgaatgctattccccagcccccacgatagttgcctgtggccgtgaaaaatcaagccggtgaaccattaaccgcctcagccttaaaagttataaatgcgggctctgaccgcgtggctcagagggaaataaatggcgcggtggatcctctctctgccaataaacttggagcttccaaggttcgcagtaagtttcggatcagataactcaaaactctccgatcttggtcaagtgcggttaaaagtgggtccgtggcaggggcggctaagcaaaatgccgatggtcggttgctgtgagaacccaatccgaggtcggacgatggttcggggcctttcgtagggattaacgtgactatatgtggattgctgcgttagtattctagtggaaaataccccactacaccaccgaagtgacttatcaatcgcttggcgtcgccctcaatcagttcagatacaatgccatgtgaccacgacggtccaagcagatgtatggttcgaatgacatccgatttaactattccatggcttcctcatcacgatggatcagacagagaccaaagagcggagggactccggatctcacgacatcacctctccgaagaaactcgtcagccagtaccacggaagtgtggaggttgttagggccggaactctcgcagcgctggtggaaaatctgacgcgccacgacaagcttgacggttccttcaaccgaaccttcttcgctacttataagtattttacctcaggagcagaacttcttgagctcctcattgatcgatttgactgctcgcctcccacattaaccgccatacagacgacggaatggacgacacagacaaagccactgattcgattgcgcgtgataaatgttctgaagcactggctcgagcatttctggtctgagccaaaagacattgatacagatcgtaacttgcgaatactgcagtcattcgcaaagcgcgccacggacgccatcgggacaagcgcaacacatcaacttctcacaatcgttcaacgccgacttgcgggccttgattgccacagaagatcggtatcatccatctcaaccgcgccaaagccaattttgccacgaaaattagacaagctccagttcctcaaaatcgatgccacggagattgctaggcagctgactatcatggaagcacatatgtttggcaaagtacaacgggatgaatttttaaacaagaactggcaaaagaaagggagccctggtacacctgagcgagctccaaacatcagggccttgattcggtattccaatcagctctctaattgggtgggcgccctaatactcgcagagtcggatgtgaaaaagcggactcaagtgatagggcatttgatcaatgtggccaacgtatgtggtagtctctggcctcaccctcgtaattttgcctatatgctaattttcacctatgacagacatgtcgtcaactccataattactctgcggtggtctctatcctggcaggcctggaaagcgcacccatctatcggcttgctcgcacctgggcaatggttaccgaacgtagttgcaacacactaaggcccttgcaagttttgacatgcagtgaacacaattaccgggcctaccgtgacacgttacaggttgcggtggcaccgtgcgtcccttttcttggtcagttctctcgttaactattgaagttgccagtgcttaaccatttaccaggtctgtttttgaaagatttgacattcatcgaagatgggaacccagccatgacaccggaaggactcatcaatttccacaaatatactatgctagcatcaaccatccatgagattcagcgtttaaaagaagccccttactccttacggcccgtacctgagttgcaggaatatcttgttactcaactacaatcggctgttgacttgcacgacatgtgggacaaaagctgcgagttagaaactcgaggccgagaccttggaaatagaccccgggacctatatacccccacaggaggcatgttcgcgtctatggtagtcgcttgcatggtcctggacgattgatgtgtttacgttgatcgaaagtctgaaattcggtggtgtcgtcatgttgcacacttagccctcaacaagagtcttctagtgtccaaacacaactttcaacttctatatttatcatccacatgtataacgtccaatacgtaaagacgatagggtattgaagctgcagtatttaacaagaaaattgccttttcgggtttagaggggctttaagatgaatataatttggatcaagataggcactttaccataacccataatcaatataactagcgttttctgagcaggataatcctacccctttcctcgtcttttttggtccacggaagacaatatcccactgatgatcaactacatattcacggccaagtctaccaataccaactagctgatcgtccatgcgatgatccatccaggcagctaagccccatcccctgctcatgcaagttcggttccaacatagcccccagggaagcgcggtttccgccctgctttagagccataccataaagtagtttcgtatggctggtgtgccatgtccaaattcggggtgctgaacctacttcttacggggtcaacgcacaagtttacgtgtatatttctacgcgaacgaattatttctgatctgcctctaatgctattagcgctcatagacatgaatctagactttctaaggtatggagtacggaccccccaacccatccgtaatgataatctggacctgcgcttggctaatttccattcttctagttccctagcgctgggttaggagaaaatgtgacattgcctaccacttgattataagcttctaatataaaggcttctagtgtttttgccatgaggctcgacttggagatagagttgctcgagagcgcttcactacggcaaaggaagcaccttgatctgtagctagaattgatgaattatttccgaggttttggttgggattaggagacattgacgcctttccaatgtcctaaccaaaccgttttctcgtaagcttataagaaaacaaaccggagcactttgtgacagcgaacagtattcgactggacagacaatgggctcagggaaagtcccgcatacactctcatgatcagtttcaatccgatatacgactagatgttctgactcgtccaaatatcaaaggacgcggtgcattcattaagctcagcccgatgatacggaggaccgaaagctgcggccaggcgactctccatgactctccatataaccagatatgatatatcagaaaagaacaccgcggtaagatgcacttgcggtgaatataagctcttcttggccttaattccttccgtgttagagcgtggttcgggccgttggtgtgttgaatggtgtcgactgtctatactattctctagaatgaggttgcagcagaccctccccgagctgatttagatacgtctcgggatacacagactcagaagaaactccggtgcccggactttatgggaactaccgggaatgagaagcaagagatagtcccgacaccttggaggggcccaatatattgacggtgcttttgcgtgttccgaaacgtgacgagtccgtgtatgcacatgtctctggcctagattagaaactcagatctaataagtcattgattatgatacgaaagggaagttgactgagctccgatagaatatcttttttgggtataaagaggtcagcatgtacccggtcaaaccccatgggtggatagtcagtcctaatataagagccaagaatcataatgcgctgtcacaaagtgctccggtttgttttcttcgtatcaatatcgcttggtagtccagtgccttcctatacatcgaaaggggctcaggatggtccaggcatctttaacaaactattcaacacatccacaagtcgcgctcccttcagcacggacatatatcaagagctatctcagctccaagccaagatatcagatattgcaacaggcaaaatcaagccagtttcaaccatcgaaaaaggtctctcagtcctttcctcaattccacacgacaacaaccgaacaagccttcaaaacgccatcgacatagtatccctaggtctagtcccatcaagtatcaccgacattctcaacggcataacaaaccacgaaataaactccatagccaacaacaacacaaagaacccaaccccacggatccacccaacaaggtcgtttgaggacgcaccctatgacatccccgaagaaagactccgcagcgcaatttacatccccccagccttttcctatggcgaaaacaacaaaatccccgtcctcctagtcccaggaaccgccgatccagccggcagcacctactacttcagctacgcgaaactctttaccgcaaacccacacacagacccagtatgggtcaacatcccggaaaactcgctgggtgacatccaaagcaacgcggagtacgttgcatacgcaataaactacatctcggcgctctcacagcgcccgatcggggtcctaacctggtcgcaaggcagcatagacgtgcaatgggcgctgaaatactggccgtcgacgcgagccgcggtaagcgatttcatggctgtgagtggtgatttccacgggacgcttcttgcgacgctgtgcgtgttcgccaagccgttttgctcgccggctgtgcagcagcaggcgtatgataccaggtttattcgggctctgcgtggtgggggtggggattcggcattcgtaccgacgacgagcgtgtactctggggatgactttattgttcaaccccagagtggggactgggcttctgcggccctgggggatgtgcatggggtcggggtgtcaaatgtacaggtgcaggttgcttgtgcagggggtgctgccgggggttcttattcacattcggctatgttggttaatccgttggcgtatgctttgtttgtcgacgctttggttcatgatgggcctgggaagttggagaggattgaccttgatgctatttgtggggagtctcttgcgcctggtttggatgtggatgattttttgggcatcgaggatgtgtcgaacgtgattggggtgctgaatgtgttgttgtatgggtataataggaatgaggagccaccgcttagggactatgttcactactaggcgatgttggtttatacaggatgctggactgggtggggatgatggactacggatggttgctgaaggcaaggctatatcctgtattagccccaggggaaatcttaaagtccatactggacagggctctatgatacatgtacaatgccaagtgcttccattgggtattattgtgtggatctctagaacgaaactccaagtccgtagagatcaccacggcaacaaaaagcatagcaggaaacctccccgccgccagccggcaagtggcgacacaacaatgagtatgaataagaaggaaacagaaaacaaaaataaagtggatataagacccggcaagcagactggaagaggatgtgccgcaaacaaacgttggaaatcgcagttcatcgtaattcgggggactccattgcatagccagcgctgactattcaacgccgacacccgaggaatggatatcacggcatggggtacgtggacagagacatggcatgctaaggagcaactcgaaatgggagtcatcaaatttggtcaaaagaaaatgttaaatgaaaagcgggcgtttatgtaggcttttcacatccaatgcgacccaagagagctttccgatcactcggatcgaaaggaacacgaccacgcccacgcgcgcgcaccgaggcagtgccgttggaccgccgacgacccaagcctggagcgtttccagtttccagtgggtcggcaggggcaccgtccttggcagccaagtgcgctgggacgcgagatggggtctgaccttccacttccgcttcgtcttcctcgtcactgcgggtatcttcggcattaccgccacaaaccacaccgtaagcgacacggacaatcatgctgaaccatacaatggacagtacctcgaggatcaacaggagggataagaacatccatttgagagtggggttgaagcagatggggttgtccaaactgaagtatggaccgagcatgtatgcgaaggcatttggggcctccgctgagatgaactcgcttgtcgagccggtgtagcagccataggtgagttcacgggggagatcataataaacggaccagcacaccatggggtagatgatgtgtcgggtaatgaaccatgtgcccatgaagaggccgaagccaacgttgcaggctgtttcgaacttggagtacttgaggatcttcgcagactgcaggggtattagtagctgtttagggacacttgatcaatagtaatcaacgaaccggtaacaagaagtccacgacatccatgagacatagcactacattggacacattatacatggcgtagatgtaggcagagctgaggagagcactggtaataatgtggtgggaaagcatctgaacatggtccttccgtctctcttccacgtgaatcacgaagatctgctgcacaaggaatgccagctcaacgagaagataccacttcatcaagcccgacaaaggacgggcgggccactgtgaccacatagcggcaaaatctccccagtagtatgacgtcttccagaggtactgcaacgtagaaacagcggttagttatatattcccaggaagatacgtgggccaaacgcaccaatccgactccccaaatgaacgaatagtacatagcttgccaaccctgctcagcgaggcggagcgactgtttgcgctttaacccgcatgcgcgggccaatggttgcaggaaccattcgatggcgatagcgcggataccggtgagtgcaatggcagcactgattacgaagtagacatcgttccagccctgcacgtaggagttcgaggattcattataataggacaattggaagaatggctgggtatatggacggagcgatgggtagaggttatgaagagccagcagcatagccagcgtggtcatggagattcctgcaaagaagcaactgatgttagtgatactagtatgctcaggatgtgggatttcgcatatgccagggattcatttgggagcatttggaagcgcagcaactctgtcagctgcagcttgcttttccgtcgtctccatgcgagccctaggattgaggtgttttcttcataccgatctggttggcaaccacccattcgcggaacgtggtctccttggccggccgtattccactgggagaggaaacgtagacattgcgccccttcagctctactggctgcgatggcacaactgtgtctgccatggtggagagagcaccaatagtatggaggatattcgaaattccacggaaggccgtgggataggagcgggagtcggggagtcggggaatcgggggagtcgggagagtcgagaacgagccaaaatgattcaatgccgagatggatgtgggacctgcctcatcagagctttatgtactttctaacttgactcgttcaaccaggaacgtgaaaagcaacaacggtgaaagtgcaagaataattttgtaggaaaaggagggaatagagggggaacgtggttcaacattcgtttcatctcttcacgacgatcatcgctccactcaccgcctcgtttaataaatgagaccctgggaggtgtgtatgttgtatgcactaggttaagatcttggcttgagatttgatatattttcttttttctggttggattccgtataaggatgtcaacagtctaccatttccggtctatttacactctttggtcagtcttctatgtcttggcgcgggatatgagaaatgggataataatagatgtggtacgtacacctgtacgatatatattaagacatatggagaattcattctaaaccctctgtaacgtttcgcacaaaatcattggcattgacccccaattgagccaaatcaattccaccctgcccggccatcacgcgcgacatagctctagcaacttcttcctcctcccaaatgttgttgatgatttgctccccaccttctccaggcccttgagtggggttctcggaagccaccatagtccgccaatacaaatcatctcgattcttcaaagccgaatcccgaactaccgcattgcgagtgacactcgcagcatggagttttgagtttgcgcccttgagcgtctgcacggccaccgataccgcctgatcaacctgttcaaccgtcgagggcggcttgaaaaagaaccggttagttgcggaaagccagatcacaagcgagcagatcgcatcgcagatcacgaaggccagcggtcgcaggagcgtgatgttgttgtagatgctggagggcggtatctggcctgcgcgcacagagcggggcgcaccctggatcgcgtcgtaagtggccatgatgtagatgtcgatagctgcgagggcaagtccggctatggtgaattttgtgcgccagcgggaggcctcgcgtcctgcgatgggcgcggatgtggccacgcctagaagtagcaggtgcgctaggtgtggtagcaacacgtggaatgggaggtagtatatgaggtacgtgtagaggttgtcgaaggagcagtattgacacgagaccaaggcatcggggccataggtcaggtataccttgcgggcacccagagaggtgaacttcgactggaggagggtgtcggcttcggtgaggaagttacctggccgaagccgggcgagacggttaaagatgacatcggtaggggtgttcaggcgagagcgagtctgagagaagatgttgggttcgggcgcgtgggggttgaaaggtaggcttaggagtagaaagaagacgatgcctgcgaataaaatgttcagcgctcgaccgggcgcggcaggcagaggacgcggcggtggccgactcgcgatggatacacgaagacttcgataggcggtaattaagcgagggagtatgactggaccgaaaaatattaggagtgatttgacgctattcacggttaggatagattgcggaggatgtggagagcttcaagacttacgttccccaagagattgtggtagccatatttgctagaatatggaccttacttcatcagaaactcgaaccagttgaatcgagtttcgacgaaagaaaggtgtaagagtgttcggatgtccaacgtagcttcattgaagtcggggccaaacgtgggtcccgtcctttctggacattaccttcaaccaccacttctacactgttctgatcaacaatgcttttcagtttccttttcaaatttaccttgaacgactataatagctacacaccctacgaatgttctagcataaaaacgatatgtatcaattaaatctgttaaacatcaagaagcaaaagcaaaagaccaggggaataaaacagcgccgaatgcgcccatcgcaataacgcaagatttctcattcaatcaaggcgagtcttccctttccttcaaaataacgctattttcgacctaattgaccagtcagccagctcaaaccatatggcccgagtacatagcagggtggtgtgcgaggtcaggagggcggatctccgcagagtcacgagagtatttggaggaagcggcgtcgttctcttcaacgagagtcgggttcatcggcttggagatcttgagtgggaaccgaccagtgagacgattcgtggcgcgcttgacggggttctggcgagtgtaggtgggcagggtttcctcgcgcttcacgctcaagtggagggtgcggtggctgctggtcctgctcattgccttttgtggtgcgacggcgccatccacccgcacctggcgggcactgacgccggtcgcgggatcactgaagatgtagctctgttgaaggaaacgggttagcattcaaggatatatattagggggttcggagtgtttgatctcgatacttactgccagaacattcaccacgctaactatcatggccaggacaccggcggagatgataatccgccagaaagtcatgccaatggtttcctgggtcatggccttggtgttcaggttgcccagtgtggctacacccaggatcatcatgatcccgccgagagagtagaaactcgattcttgtccgaacatcggccagtggttgtcgaaatagctttggaggaccgggagctccgagattatcatgaagactgcccacgttagcattttatactacaagcatggaaggaagagtatacttacggctgaccagagccaccacggcatgggtcacagcctcgaagaagaagaagctgttcagcatgtcgatcttggccagcaagactgcacaagcagctataaggtccataaaggtgataatgttgagaacgcgaatgacgttcaggatcacgtaccctggaccagccagggactcacgcaagcgagtcatcatgattgaggtacagggctgtttctgcacttgtcaggaatggtggatactcgctgtcgaggatgtatagaaaattgtctgctagcagacttggaggggcagcgttgggattaaaagagggaagaaagcgactgtccagcagaaagcttgataattccaagaaagaatagaacaatgcaatagaacgagatcaactcgagggcaaggaaagaagaaagaaagacaaagacacaagagaagggtgaatggcgacaatggagaaaggcatctatggaagaatggccattgaggtacagcagcctaaatgtatgctccggacaaaggcaatagtactatttctatgaatagacttgaaacatctagatgaaccacacaaacagtatgtatctaattagagccctactgaaagacatctgcagggttcctctaccccatttctgcagtgaggtatactgcaggaggcccggggtgtttcaatatccgtgtaataaatagggacttttaaccgcagagatggggtcgtcgccagaacaagcctaattacctacatctccgctattaggatctcaactagagcccgatgtagccaaatgactggcccttagtgaaagatactcgaccatgctgaaacgagttggcggctagaagtcgcccttctttcctccgtgttgccggtgctttgtttccgtatgcctcaaacataccttatcaactgatgaatacagtacaaagaattctaaatcatacatgtatcaacgttgatctggcaagatatttgaagggtaaaatacattttaggtagtgggctttgaggcaaagcgccaggggtgaagtacatatgtagaaagccagagttgaaacaagataagaatatagcccaatcacaggcagcgcctagtcgctgaaatgagtcaatcggataaaataacaaagaaatacttgaaatacttcgacaatccaacgaagaacgttgagaagaaccttgcaagtgtacagtgaaggtatacagaaagtactagatgagtggaactcctgtgattcgccggaatccagccgacccctccaaactcccgaggtctttttttccctctctcactctccaaccgtttcgcccgcaactacctttaatactcttgaacataattggaataatattataaccatgacacggggtaaccaacgtgacaacgaccgggctaaggccctcaagaaggcgggcaacacggttcgtccttattctcctcctctttgttcatactgaccatttctacagaaaagcaagaacaccctgtccggtagtgaattcgctaggagcaaagaagatgccgctgccatcatgcgcgagaagcaaaggaagggtatgtgtccccgaaggcgctaggcgcaagtccaacctacactatgagactggtttactgatcacttctctcctacagccgatgaaaagaaagccgccgagtctgcagcaggaaaaagcaaaaaataatatacctcaatccatcgatccaacctgtcagtcaatctcatcttcctccacctttatagcgatcgcccgaagcagacaacccacggagcagcatcgcaaagtgtactacgagtgaaggacggcgctggatctacggatacgatcggaatcatccacctatgtccaattatcaaaacctggggctgggtgtctagcgaggcgttttttgaatctcattggcgttcatcatatttagcccaagcatgtatacaaaagcgctaaccaaacgaggtaacgatacatgagaaatatcatggaggtgcaattttggtggtaatcgtaaacacgtaaaaaaaaaagatatatacatccatcacatccggttatatatcttgcccttggccgtctatgacccaacatactctcgcccgggccagccaggtctgccatgacttctcccgttgactgtcctggtccttttgggaatcacgagatctggcttcgtgatcgcagtgcgacagcatgatatcctcgatcatgctttcaagcacaaacagccgcgatgcttggtcgacaaacgtccaaaggctctcgccttcccatccaacgttaagcgcaaacctgaccactttcccaagagcattcgctcgatgttggtccggggcattgctcagcaggtagaggctaaagctccaacccgatatatcgcgtggattaaccaagcaccaatcaaccacgcgttcgacaactgactgcgccgaatgggtttcccactttggttgccccgtcgtcttctccactgttgcagcgaggagcacatccaactgtcgcatgtaactgaaggcataatagttcttgggatgtaactcgccagcgcggagaacaacttccagttccgtccgttgcagcttgagcagatcctcgggactccaatgccgcctttgaagcagatggacaaccacccacagccggtgatgccagagtgtcggcgacttggtatgacgatgtagtggcgagcactggtagctcgacatgagcgtgagctcggcttctaacaactccgttgcggcagaggtctggtttgaaacaccagggcaatgtgccatggctgcccgcagtcggcgcttgcgccagttacaggctgtgagatgctcacagtcaaagaggagcatcatttctgtaatagccgagtctgcatttctggactgggcgttttcggaaaatgtggtttggaggtcatcatcggacatgggcattaattggtcgaagaagagctggcgcgcgaccgtgaagccctgcactagtgctttcttggttattccaagtgaacatccatcttggagaaatgtagcgcctaggcttggtgggatgatctcgatctcgaggacttggttgtctctagacgagaagatacggacaagttcctggaatgcatcttccggattggacatttgaaggcttgatcgtctggtggaaatcgggaggaataattgtcaaggcctcatcgtatcttgtctgtttaaataattccgtatttttttttttgccttgcctcagacaaggtgatagacgagatggtgtagaccgtgacacagtgaaggcggaaagaccaagtccgctgttatttccacctttccacaacgagggacgtcattcataccttcaaccagcaaccaacatctacccaggacattcccagtttgaagcagcagacttgtcagggactcacttagttgactgactgtcgtcgctttcattcaggctcttctagcctgcgctgtcgcatttgacgcctgatctcggtcttgccagcccccgccacgatgttgtccctcgtcctcacggtctttttcgtgcacgtcgcaatctacctggtcaatacgattggggcaagcacaattgacagccttgtatgtctccaatccgcccatttgtgggctctgggaagcttcccagctccgccgcgcacctacactgtgatccaacacgctaacacctactctctggcatacagctatggcttctttatctaaagctgccgacaccaacctcgcggactgcacgcaagcagcagcagctgaaacgtcaagtcctcgagcagaagcatgaaatgaacagcacaagctcccaggatgagtttgcgaagtgggcgaaggctcggagacgacacgacaagagcatggaggaatacgaggcgctgagtacgtgtcactatcacaagactgcaaaggaggcaccgttatcttgttgactggactgctgacacccttctctctccacagacaagacgctcaccgcacagaaatcctcctttgactggactgtcaagatcgcccgctggttgagcacgaacgggttgaagatcttcctgcagttctggtactcgaaaacgcctgtcttcccgcttcccgaggcctggttcccttactacgttgaatggattgtgtcctttcctcgcgccccgcttggatccgtcagcatacatgtttggagtaatgtctgtgcgactaccatcgcgctcaccgccgaggttatgggagcattgctggtgcagattgtcggtcagaagaaggaacagagggagactgcgcctgtcagcgccgagggcaagaaggcacagtgaatacgacaacatggacctggctatattgcatggaaacgggttgtactatacgaagagaaatgctacgatttagctacgaatattgcattttaatcattcatttcgattgcattgaaaaattggctatatagaatgttcatcagataattttaaatcgtttatcgtcaacaatcccttgggatctctgtgcttgactctatgattggtatatcatcacgcgaacaagaaaaaaaatgaagcctatggcaagatataagagtccggcccctgtgacagggcttctgcaatgagacagcatctcatcaccgctttgccataagctacagactcttgaaaagaaaagacaacggaactcctcgcctcaagaatgagccccattgagttacctccatcgacttccgaggaagcagacaggaggcaatcgcatgactatccgaacatgacgaaaggcaacccaatacaagaaaaggtgttttaccaccaattcttcccctctccaacacccagcacacaccccattgtttccagagacatcgtgatgtaaccgtcgggaggcacgggatgccgtgagagaatagggcgtaagccgctatcgaattgcttctatggcggcgcgtttccgcagtgcctggcttggtacttcggttttacccgaagcgcagggtgtccggggactttctcccaaagcaaaattggaaaagggagccaagcttccttttgtgtgtgagctttgaatgcgattctttgagcgaggagttggaagaagaagaggaaacggaatattcggggcgaggcttttatttttcttgcgctagtcaggtgatggcactagtcctacttgggactagcgtatatggcatcgggttagggcttgcgatgttccaggttatatacaacatacaacataggaaagtaaagtatcgagcaagacgcggtgcaaatgatgggttgctcactgatgaaatcgctcactgataaaatagaaatagagagaatatacctcaaaagaagtcctattagcttaaggcatccctatcaaccactggtattcttttcacctttcacatttttccttactattcattgttcatgctaatttagcctttgaatattaccaaaaggaacttagtgatgaaaggaaaagaaaacacaatgcatttgagaaagaggcttgatgaatgaaattaaaaacaatttttacatgatcccgtttacgccttggacttggtcttggtggccttcttagtgacctttcccttcgccttggtggcaggagacttagcagccggtgactctgtagcagctgccttgggtgcctctgtcttcttgcccttcttggccttcttgggggtatcatcggtaggaacaggagcctcaacaggagcaggagcctccgtaggagcaggggcctcaatggccttggtaggctcctcagtggtggtctcaatggcctcggcggcctcgacagccttgggggcctcctggacggggacatcatcgacgctcttcagttggggaagatcaagctcgtagcccagagccttcatcttgttaaccttggcctctctcttcttctgctcggactcaatgttcttcgaccactgctcgcgtgtctttcccttcgcgagacgcttcttctcgatgcggttccatggcgtaaccttgaagcggcggttggcgcccttccagatctccgggtgcagctgctctttgggcacgaacttgcacttgacgatgtgaccgtacataaggtagttgtccattgtgtcggcgacgatcttggcgacggtggtcgaggagaattcaatgaaggcgtagtgcttggagcggccggtgaagcggttgcgcgagagacggagcttggtaatttccccgaattgggagaagtaagccttcatctggtgctcgtagaaaccgtgggggatgcgtctgagaatgggatgttagatggttcatactagtcagaaaccacggttaagactcacccaatatagacggtaccgggctcctcgggagggccgttcttgcgcagctgcttggcgagcttgcgctcggccttcttggtgtccggggccttggggataggttcaccctctttgtaaccctcgccatcggagtcgtcctcgtcgccgctgctctcgaagcccttgatgagagcctcagtctggtcatcatcaccctgattctcagcctcgctttcatcagcgggggatacatcctcctcggcatcttcctcttcggactcgacgacgggctcgggcttcttagtcttgggagcggccttcttcgcggcagccttcttgggggcgggggcggcctcagcctcctccttcttggactttttagcggcgggcttcttctcagccttcttgtcagccttcacaggcgcgacaggctcatcgacctcttcgtcggtaaggaagtcagcagcacgcttgcgaggcttgacctcgcgtgcgggcacgccattggtcttggccggcgtagcagccttctctgtcttggacttggtacccttctcattcttcttcaagatagacttgggagcggtctccttagttgcctcggcgggcttggcctcgaccttcttggtttttttggcgggtgagtcggcggcgacaggcgcagctgcagtagcgttagtgacatgaaaataaattccaccggtcataagaatctcacatacccttgcgctttgagactctcttgtcaggggccatttcgacgttttgttgtgtcgaattggagactgtatgctgctcgatcatctgcgggaaacttttttttcttctctgatttgcttagaaggcggtgagccgcctcgaccaccgactacgacagttaccgccaagatgtctacttactacaaccccaaatgggccaacatcatgggaaagaataaaaaagggtccttgacacatgcagaggtctgggatgattctgccctggttcagtcctgggacgatgctgtcgaagaataccaggtcagtaaaccgagtcaccaattcacgtgacgaatatctaactcgacgccagcattattggagcattcacgccaagggtgaaaatgtcgaagatgtcttgaaagaagcggaagacactggtgtcattccagctgtacgtcccggtgacaatgaacgcaccaaagccgcagaggacggtgccactaaacctgagaatggggatgtctggatgaccattgacgagcaggcttctgagtctgctcccgaggtatatttccattccaatgatttgtccctcgtcaaaggactcgctgacgatatatagccttctcaacccgtggctgatgccagttctgtagtctccacgcctgctatgccaatgcctcacccaatcatggcaaacggtatgttccgccctcaggacatgttgattcatgtaactaacatatattcctagtccaagatgagtcgttgaagaacctcatgatgtcatggtactatgcaggctattacacaggacttcatgaaggccaacagacaagccgcggccagagctcgtgatgcgattattgctcagagacgaagggaaatttttttttggctcgaatgagcacatcagcggatacaatacaggttgggaacaaatcgtaacggacaagcaatggaactaatcatatcaaattaatcgtgaaacctgaaaaggatctcattaacattccccttgcaaacaaaagtaaacaacgaaattaaatattgaccagctagcgtccaccgaaataggattggcttcagcacagatcctgtatcactttcatatcctgtctcatatatcggggctcgattcttggtgaatcagagtccgcccagtccgcctcctgcgccaccaagaagaccaccgacaatgggaagactgcccaaggcattaggctgagacgtgggcttgttggtaggggtagcagtcggggtcacgaaattgccagaggaaagcttcttggtgggggtggcagaagcagtaggcttgctaacagctccggtcttgccagccaccttcgcggaaacattggcctcctgttcttgggcctcctgcttgttggccttctgctgctcctcatggttctccttttcattgctatccttgttgtcgagaccatccatcaactttgtggcatgctgagttcattgattaatatgatacttctcatggtggctttgtcacagttgactaaccatcaaatctttaatagtaccatcgaggctaagtccgtgactgggggcttgtccgtcacgcttggtgggcatggagagagcaaaaactgcgagcacaagaaagatggagatgaatgaaaggctgaaacgggccattttgagtggtgtatgttaaacaggatatagatggagggaaagaatatatgttcaagcaattgtcttcaaacgagtgtgagcaagaatcgctgaggaaaatgaatgattgttgcaaatacacagggcgctgggagaaacagagccataggctctgcgggccttaggtggaatttatatgcagccccttcgatcacattatggagggagtgggatgccagggggcgagggtgaagagtcttgttgcgactagctaccgcgcgtcttcgcctggtattcggactccgcgtctggaataaacaacaatactattactttgtttattttatgagccttttggccataccaaaggctatttcggggagaaagattagatttgttcagctatatgttgaacatatgtatgggctttaaggcctcctattttgaagtatatccgtcgaagctaatggctagcatgagatcatcaagggatattcgatgatggtgaatcagtgcatcgaagtgaggaaatggaccaaggctacgcgaaccacgcctcattatgaatcgtgccgcattccatgttgaaatgttagggttggaaggacttcatatcatgcctgacagccgcacccgagcgctcagcaattttcatgctggttttagccaaacaaatcctgaggacctgtgcagatttcacagctctcttctgggaacttctgtaatgcagatgcagctactcaaaatgcaggcactaaattcccacagggatggaaacccaggtcttcgacgaagggttgctgcgagtccctagcaaggattgatgtgagatgcagatctacagcattccacaacgacggagcattttttgtgtttcctccgatatcaggaggcggcgcctgtctgtgtgacaagtcatatatggaatagcccttcacaatttatagctgtttacaaggaatgtatctcccaactttgacacgcacagccccatagagggagcggacgtaacacgagggagtctccagaaggacgtatccaactgtgagggcttagttttggcatctttttgacctcaaacatcaatataagacggacaagacttcgaagatgccaagattgtttacatctatatagctgtataggagttagtgggtagaaaaaagaacatgaatatgaatcatccctatctggaggaaatgaaaggaccatgcaagttgcaaggaaaaagtggctcgcagggttgaaactcaagcattaagagttcggtgccagccaaagctaacccctgcgagtaaacatttccaaatgcatcagactctgtaagaccaaatcgcaagattcatatcaatacagcatgttggctcaaaagcgaacccgttcccctctggctgaatgtcagggggcgggattagaacgagcattcttcggtctgggtccctaagctaaaatatgtagatagagtgagattattccatcgacaagagtgtgttggggaccgtgaatatgttttgaagtgaagaagaaaggaaaagagaaaaccgatcgcaaaattttattcgacgggcagtagcgtggattatgtcacgcggtcacgtggctgctatgcttcctccaatgtggatctccagtctcctttgctgtcaacacctctctggtttcgattttaatttgacagcttagggatcaaacttcaatgtcgtaaacacatctcctaattcctctttgccgtgcattagcaggtccacagccatttgggaatcttcaaactagccatacagctacgactgagataatataatcgcaaactcattagatcggaacgacgatacgaccaaattatttgttcgtgttgccgacttggattctatccgcttctcctcccattcggcccagccagcatccattgacgagttttcgtctgtcgaccaagaatcatgcgtgatataatccatctcaacattgacattcgccgcaccagagagagccataatgcggctcaaaatccaatgcaattgcagatgtctccaggcatgaagtggatggaatgtgcggccgttgttattttgaaatcgtcaccgctgctgataggatgaccggcggagggtctacagtctgcaaagtcgagacgggcaacactgttgtctgcagaatttgtaggccacccagaagggacagacattgatatcagcacaatttgatcgttgtgtttaggcaactgctctgatgccaatagaaacgtatagtgagctcgatatctgacacttcaagcggcttgaaagtgaaatacccttttttttttcccacagagcactagcccctgaactgagattgatcacattcccaggcccatcaaaggcattggctgggtcgtgaaaatcaaggcacctgcgagacatattcatcacatgagcatcagaagggtgctttaccgaacttccaatgctgtgggatggagagaggcctacagagatgtcaaggtgaatgatgaaatgtaagagatgatattgaaggatgatattgaaaggctgcaaggctctaagggtgcttgacaatgtcggtaacgactgacgaggcaagatattccttatggcggaagtaatatatatattgagtatgggaatttctgtgagtgaagacgagacaaccttaattctgattatctgagagaaatttgaggtcggccacatatacacatgtagttagttgactacaatttatgttccacagtaattgcgccatcctcacaagttgggattgaagtagatggtggtggacgtgacaagatccacggattatgttgctgctttatatattaataacaaatcgaagaaaatcacctctatagaggcaaaaccttggtgaagcattataggtctccggataccataaatacttatgtgactagaccaaaaaggggtctcatggcctaatacataaaagtattaacgcctaggtagactcccccatgttgtcactgcaggatgctatataagcacacaatatatatagcgatactcattaaatgccattaggtatcttcaaaatgaatgtcttacatagtaggaatagggcacattatagtcagcatcaataccatgttcatctacatccaaatctataggtacttctccctgcagatccccgccgatcccgccgatcttgcgaataggggtgatatcaacacctaaggcatcaacactcccacatgtcccgaaatatctgaaatatcatgggggcaaaaggaaagaagacacataattgcatgagtaaatacacaaaatgggccgaaaagtacaaaggtcatttatccaacttatcatctttctctgcattctcttctttatcttatacataaaccgtccgcaatcaacgaaagacaaactctttgcttggaccaaaatccgctacaaaacaacctcatccatcattccggaagcccgcggaatatgccccggcctagcagaaacaaccaaaccagccctgatagtctcacatgtctccacggacggcgacccatcctggctagaaccactccgcacccagtaccatgtatgcatgtaccaagtggacgcgccagcagacaaaacttccaaactgctccaagtccccgcaaaccgcggacatgaagcaatggcctacctaaccttcttaattgacaactacgcggacataccatccgccggcgctgtcttcgtccacggcagccgctgggcttggcataacgacgtcccagattacgataatgctgcccttctacgcagcctggacgtccgtgccgctctaaagccagctggatacagcaacctgcgttgtgactggagcgccggcacgtgtccttcttctgtgcccccgcagggcagtcttgagacgaggctgtcgagcgccgtgtccccgtggagtgcgcgctcggcatcggatatagcgctgccgaaggcacttggccatatctttggtggagatgctgacgcacgggtcaaagagatccgcaatgctttccatctttatcttggtcggaatgatgccgtgcgtgcgcagtgctgtgcgcagttcgttgttgcccgcgagcgaatctggcagcatagtcgggatgagtatattgcacttcggcagtggctgcttgatggggctgatgatggggttgcacgcaatgttcagcagggctctatggctgcgcctcctgatgaccttgtggctggccggattgtctcgtatctttggcacattctttttgcgagttacggggatgaaggagccattgatctcgaccaattgaatcgcgatgcttgtccaagtgcctctgagtgctattgtcggttgtataggaagtgtgatttgaagtgtcggggtccggggagctgtcaagggcagtattctgtgccgaagaactacaagctacctgagaattggaaggagacgcattcatgattcatgatttcttttgcgattcggaaacttgtttatagaattgatcttggaacattttgggcatatagatcgggcagactggggtgcattgtgaaataaattgcatgtcgtgtcatttcaagtgatagaattatgtacaagttgttcaactaaatgatgtctgcctgtgcctctagaatctggcaaggacccgctcttcggtatctgacagggcatactcagaggcgtgcttcttgctcacgacagacttggcctgctcggcagtgaagcccttggcctccacagctgggttgtagcccaggccgttgatctttccgacaacgtccgagggcacagcagcggcgaccttgccatcagtccgcttgtagacggtcacgacaacggcaccgcccagaccgaggttgtgttgcagtgccgcggaagtaccgtcaatcagacggttgttggcccagccgcgcaggtgccagactagctcagcacattgggcaattcctgtggcaccgagcgggtgacctttggagatgagaccgccggacgggttgataaccatctttccgccatacgtgatgtcgccacggcggaccatctcatgggcctgaccgggttcacacagctcgagcgcatcgatagtaatcatctcattggcggagaagcaatcatgcagctcgcagaccttgatatccttgacattgacgccggcctcagccacggcagtgcggcatgcccggcgcgacatgccgaagcccatcaggtcaatggagcttttgttgtagactgtatcggtatcagtggcaaggcactggccggcaatgaggatggcatgttctttcaggtggggtcgcgcatcaaggaagtcctgcgagacaattacggcggcagcaccaccatccgaggttgggcagcactgtagcttggtcagaggctcgtggatcatgggcgccttcataatctgctcgtgggtgtattcggtttggaattgcgagtaagggttgcgcttggagtgctcgtggttgacgcgagcgatctcggcgaagtcctcattcttagcaccgtacctgtttttcacctattagcaccatatcccttcttgtcatgggttgacatcatctcgaggggttgcgtacttctccttatattccacacccgcatttccgaacatttgtgcggcaccgggcgcattggtcacaccccgcgtctcggccatcatcattccaaacagtccagttgggttctcgcgatcgttgtacatggattgtaagctaccggggttcatcttctcgaagccgacgactagcacacagtctgcagcaccgtgagaaaccatcgtgcgggccatggcgaggccagtcgaaccggtcgaacagttgttgttgacgttgtagatcgggatgctggtctggccgaactggtagaacacgcgctggccgcaggtgctgtctccatagacgtagcatgctacaccctggtcaacatcgtcgtagttaatcttggcgtcgagcatggctttgatgccggcctcatagccgagctcatggtaatcgaccttgccccttggcttgatgaacttggtcatgccaacgcccaggacataggcgggggttccttgcttctttcccatggtgtatatcttggattattggtagaggtaaagctaagtggactttgtataggttcaactcgggaagtgagaccttataaagacgaatcagcggtatgtggggagctcagcatgaaattgcggggatagaccgaggtcccgaggaaccacgtccacggcacttgtgcaattttattcacataatcatctcgacattatcatgttgatattgccgattgcgcataacctaatccagggggttggaaaggaaaagagaaccatgtgttctttgattgaactccaaatgtagggtctttcttatgtgaaacaaggccaggacgtacgagacaatcacagggtctactattcatatattcagccattctaatccagttgatctagtagcatgttggacttgggcatctttgcagtcgcccaagttgatatgtcttgattttctacgaacatcgttctatgagccacattccagccaacctaacttgcagtcttcacaagggaagcaatggagtgccccaaacgatctccgcccaatatagcatttccacatgagagggctgtgacagtctattgcagtggcatgaggcatatgccccaatattcaaacggctgctccctactccgtactccatacaggatcgggtataaggaagctggcagcccggaagtacggattgttgcttaatgatctgcagaatctcccaaccatggcaaggtggttgaatttgagtctggaatctggtttatagtcattcgatgatttcgatggatgtgattaattagtgggtgggtaatgagcccaatccctgcgtggggcccggccacggagtactgtcttccacatatattgcacagctcactctgatccgtgggctaaccttctgtgatcttcccgaagtctgctttgcatactccgtataccatacgtatattcctgttctgcacgaaacgtataggagatagcatgatcagaccgcgaccggcggatgtgcctcggcagtgccaagactacatagagatagcgtgatcaatttcctgatagaataagatcagggtctcagtatagatatacacacaacagatcaaacaatgccatttccatgatatccacgggtgtttaaaactgatccggggggtaagcaccaagtctgttctccgctgctgttcacgacgacgtcactctgtttggccctaaaccgctttgagcgcccaagttaagctcggtccacatgccattttactgcacttctctcttcctcttcttcacattgcattaagccaccttttgttgggtgcgatattgagggaatatcgtcggtaagtcctcctcgtcagactgggaagctcgtactctggtttgtcctgctatcgaggaacgtggggaaaacgaattgatgctaatggtcgtcttcccccccacagctcccgaccactatcagcaacacattgctatagacgacacatcctgggcaagaatatccttgctgtctggaacaggggactctcccagaacatcatttgaaccgctcaatcctgcgccacacttcctagataccatttgtgaacgcggggttgcatccgttgccgtggccgtcattggttcggccacctaatatcgaacctatctcataatctgcaaatacggatcgaaacgtgccaatctatattacaagggccttctgggataccttccaacagactgacgatagaactgggttggccgagcccgtttaatggtcaattgtgggacgctgaacggtctactcgagttctgagagaccgctttgcgttccatcgggttccccagcctgcaggtgtaagagactgtgcagaatacgtgttgtgacgtctggagagagattgttatagctattcctcgctgccgccaatggaggtcgttcagggatgactagtgacaacagctctgaacatgcaccattatcctcgtcttcccaccacacaagaacagccgctatgccagaccacagagcttggaacatggatgaggtcacacggaacagactcctcaaaaagtacaaaacccaggtggcttcgggggcgtccaccatttgcgcgacgctggcggtggtgagtgctttattccgtgggcttttgctcggactcctgattgcttatttaccactctaatgggatgtaaaacatgctaattcctcataattccacgggcagactcctttagagaacgtcaagactcgtatgcagacgtaagtattatacgtgacattggggatgggattagtatgctaactgatatgaaaggcacaatttcaagaacatatggcagtgtgttcgctatctctggcgtactgaagggcctcggggatatgtagctggtaagtcggtatccatgggtcggtagctgaaggatgagctgaccgtcacctaggtgcgctcccacccttggcgagcgttacagtagttcgtgtcgtcaattttaccgtgtacaatgccttcaaggacataatctctgataatgtcgagcgggtaactggttccaatcctttggaccactataaacagcctggaagcacccccaccttgacgggtgtgcttactttcaccactgcaggcctcgtcgctggcttagtggcatcgcctattgcttgtatgtttatgttgcttgcatgaaagagtgggaggaaaaggattgacattgaaacaggcccctttgagctggcgaagaatgtcgtccaaacctctgttctagtgtcgaaccgtgcgatggctgccccggacgcagcccgagaccagtctctgcgtcacaaaccccgattggggacgattcaagccatcaagcagatatacgtacgacatggattttggggcctttacaccggtttccgcctgcatgcgttgcgcgacactgtcggctcaggactgtacttcagtgtttatgagactgtgaagcaagtagcagccaaggagttgggtcaggacaagaatcccttcggggcacctatgcttgccggtgctgtttgcagcactgtaccctggttttgcgtatgttatcggatcgataatcgataccccgtttcgtaatgaacaggcactgatatgactcatagacttatcccctcgatacgcgcaagactcgcgcacagagtgttcttttagggaaatccagcgagattggcgaggcctcccaggctgtcgccaaatccagcatgtacaagggcctttccatcattcttatccgaaccggcgtcaacaacatgatcctgctcagcattttcgaatacattagaatgcgtatcgatgcgttgccgaaatgaaccccccgtgggtagggccacgacaatcatgttaggacgaaataacggtccgcctgttgaacattttccttgccatagtgcgttggacatcatggttccttctcgtatttattacccacatacatacatggatgagcttgaggctcattttcagcaaatagcagaagggagtatcaaaatctgaagtgatatatgcacgaaatgaaaagaattaaaacaatgggcgcaattgtcgcagcgctagggtaacctcatagtcggcaggatcttctcggccatatagttcgaatgccacttccaatttctttacccaggttttctgttccatagctagcccggcaatgcttttattactttttgacttgaacaattgcaccgtttgggttaagctcggtcttagccttgcgtccataaaatcatctagcaatccctcttcttcgagaaagaacatcgtgagaagggcgtagatcaacctagatgagagagttatactgaaagtctctgcgacaaacttcagtgtagagtcgaaaataatagcatgcgaactttgcctctgcccatccaagtccacgccatgcgtaaggtattgaagccctcgaatcaatcgccgtcgcatgtcgctaagctgttggaagggagtgcccggtagacacgccacgcaatcgcaggtaaatcgcagggcttgatgacgctcatatctagtcctgccttcgaaatctggattataacagaaattgatctcctcgccagcgtctatgtccctggtagcgaagcttgaaatgacctctccactaacagttggaattttcgagttgggtgtacaagaatgattgaagcgtgagtgcaggggaaaaaggccataggcttcgggctcgtcgtggtctgaatttgcaatgttgaacgagttttcagcgaaagcttcattcatacttgtaaagcagcctgacccattgtcgcgaaggagtaaaaactgtgctttttggctgggcagcaattgttgaaaggcaatagaaacatgataatccgtgatttcggtatgcgacctctggataacgaaggttgggttttcgctcaaaatcagggatcctcggtcaatgcgtcttgtggcgaaagcaccccatcctttgcctggcgagggcttcagctcgaatggtatttcatcaggcacttcaaggcggtggtgcgctagcaaatagtaagtcagatgcattctcagctattaagcagagggacgtacgatgacctgcggacatggcagtgtgagttgtcacaataggaccgggtttgaaccaggttgcgggtcagaatagagtataatggtagaatagaacagaccggataaatcgtgaaagaagacacgatagctctctcagaactggggagaagccgctacctataggccaggggagctctcccaaccaacccgggtttgtatacggagtatgcagggagcaaacacatcgatctccgtaatgcaacaaagaaacccaaaagcatgatcccaaaatggcatagcttgtcaattaataggtctgttgcgcgttggagcacctggatggtgctggacctcgtatatcgggatcgtctggcacagggcaccccctgtttgtctaacaaatctgcgtggtgatctggccggctcaaaacgcgctaatgtcttccttttactacctcagatgtatgaggaaatagcctaggacattgacagggttgtagtcacattaacccacccttggactgggcggagatggcagaggattgattgtaccagagaagccccctagctaggttgaccatcctccacctccatcccaagtagaattttattatcactgcgacccctttgccccatttgctcttatcatcctgtctggctaatgccacaaacatgatggacagattcctcatgtttcgcagtgctgctcgccccctttcgcggcacctagtcgcacaaggttctcggactcgtcatttccatataatcactacggatttcatcactcaagacacaacaggcaacttggtctgtaagaaggtccccgtgtttatcgggaaccctggcgaagcctatgtattgatttccccatcggttggagaaacattccgtgatgccagctctacggcggcgacgcaagaccgatgtaaactgtcatttttccatgacacgcggcattttggcctccgtgagactccttccgtattgggcggaacacacattgaccaagagtgggtttcattctagaatcaccgagttatcctcgtcttcatatcccaacccaatttccccgcaggtcggagtccaatacaagtcctgcaaccattttcttgagcggaaagatgcatgagattgtcatagatggaactgatgatggtacagcttcaatccttgcttagggcagtccagtgctaatacatagacagccgaatttgccgaacacgctagcgcttctgggcagaacctgaagcccgtccttgatcagctggagcatatgtgacctgactccaatggcatatgaagttatcttgggaagaaactgcctttaggtatacccaggtagatcgatagttaaggacgaggaataataatgggcgctttggtcgtgggccattcccagcgaggactcatggacgtaggcctcttcatctattacccaacaaaagcatacagggcaataaagtggcgcgggcgtaggatgagtcatttcaatgtccagaacttccagcaagcgccaaatggaagggtagtgtccaatgaagagtgtttttagccatgtattcgaaacaatcaattgatgcctcaggcgatcaaacgtcatccccgttgcccggtggggttgaacctcccgccgtcaaaacaaacggagtcttccacacccccgcctcgagcgacaatggcatcgtgagtactcccatcagcatgcgagcagctgtgagaagagaggaatgacactaacctattgttctgtttgatctattcagtaatatcctccaactcccgttccggcgatcacatactgtcttgctttccgaagcgatcacccaatacatctcgtccaaatatgatcagcgcccggacatgtttgctgaggatctgatgatcattgatcgcctacgatctgaggccgtcaatgtccaagaaccgcattttagtggcatcagccgcctagtcacatatgcggctcagctgaaatggctgggtggaaagttcccgattgatgtgcgctattatttctaggttctcgctctctgatttggcgttgaagacttaccgttggcttgctatataggttggggtggacttttcgtggtatccagcttttggctttaatacttcgcggccgggtgagttgacttcttgggttcacacccttcgcatgcttctgatttggtggatatgagactaatgagaccgaatcgtgacgtttagtatcgcaaaataacctgcgctttgaactggcgaatgtcttattcaatctcgctgcattatactcacagcttgcatatgcgaccaaccggactaccgcagatgggctcaagcaggcgtgtaactacctctgctccgccgctggagtattgagccaccttcgaaccgatatcatcccggacctccgaacgtcgccgccagaggatatggacgagatgacactgcaaagtttggaacatcttttgctcgcacagggccaggagtgtttctggcagaaagctgttaaagatggactaaaagacgtgtctattgcaaaactcgcagccaaggtgtctgacttctacggtgatgcaggcgactcggctgtcaaatctaatgcaattagcacggactggattcaccacatgaccgcaaagcatcaccactttgctgctgctgctcaatttcgacaggcgcttgactgcttggagaagcgcaagtatggagaagaggttgctcggctacgcgattgtttgatctgtgtcggtgaagggctgaaagagcagcggtggattaatcggactgtactaggtgacttgaatggattgaagagccgtgtcacggaagatctcaagcgtgccgagaaggataatgacatgatctacatcaacccagtaccgcccaagtctgagctcaagactattgagcgtgctagcatggttcttgccaaagcaccttcacaggttacggatgcgatctctatgcttggcgataacggaccgttgggacaaccgctgttctcgaagttggtcccatacgcagttcacattgccgccagtatttacactgatcgtcgagaccgactggtcaatgatactctcatcggagagctggagtcgatgaccgacaagttgcgagagtacgtatccgaccgaaatactgaaattcttaagaggaaatctgctaacatcaggtttaagcttactttcatctctcaatttgccagggtcgttacaagcgctcgagaagccgttaggtcttccgccaatgcttgtgtcgcatgcggaggaaatgcgccaacaagatggtctgaatcgcttgcataggtctatcgaagacaccgccagagtcaaaggcaacgacctggctgtctataatgaaggcgctgaactgctagcagctgagaaggccgaggaccttgcagctcgccataaatacggcaccgatcgttggacccgtgggacctcagaatctgctgcacctaagctttacaagagtttgaccgaaatcaacggctatttcacctccgcccaaggcagtgatgacctcgttcagcgcaagctgcgagattcacactctgtctttatcgttctcactggcacgaatcgggacttggaatcctttgtgcctagtagccggagggtcgtgattccaccggaggttgagcgcgaggctaaccggttgcgcggttgtttgagcgaggtcactcgaatggagaatcggcggaggcggcgaattcaaacgttgaaggacaaagctcgcgcggatgatattcgtacgtgttttctttttcattggtcttggattctactaatgaatcggatttagatccggcacttttgacacagacagctcgactagagcgagaattccccatgcagactatccaggcaagccagttcgaagatctgttcgaggagcagctgaagctatatgattcggaccgtgagatgctggctcaggagcggagagagcaagatcatctctcggatcaggtccgagaagctaaccgggcatttactgggtctcatcagggtgacgcgtcgacaaaggaacgagaagcggcactgcaagatctggaaaatggatacctgaagtataaggagatcatttccaacctcgatgtcgggcgaaagttctacaatgaccttgcaaggatcgtagcccgattccgcgacgacgcaaaggcttttgtccatcagcgtcggatggaggcaagccagctggaaacgtacgtgttggccaccgctgaactaacagattagcactgacgttaaatttccttgaaccagagatatctccaatgccacagcgatggcctcactgcatgtttctccgccacacctgcgccaacaacctcaggaatcacctcgaaccaatcactcctcctctgtcttctcagctgcgcagcctgcccatgtgccatcacagccgcccccgcctgttcacaacgtacgaccagccgaggcagcaccccctctcacggccccccaaccagtgcgggctcccgtagccccgcccccagtttctacgccgagcatgccagggggtatgccgggtatgtggactcccgaaatggggattcgattcggatctgccggtgcccctccgaatgttactcccagtacaggaactggatcggccccgggccagcccactcgtgcccctcaaccgggaacctgggatcctagcaaaggactgcgcttctcttgattatgttgggatacaatactgtttaaatctttctttgtagaatcccagctctcgcacatactctggagttttgttagatgtttaccgctattcctcatgatctatggcgcgagtaatgaggtacgatcatagccttggccgaatatataatttctgcgaattgcagacaatccattggaacggattgcccatgtatttgataatgatcgagacccagttcaagtacaaaatagcatttttatatccacgtaatatctcgtagtatgtatggtacatctgatcgcacgaacccaggaatcgcaagttcgcaatcaacaatcggacagggaacaacgcctaaaagtgaatcgacatggtacatggcatgggatgacggattaaatggaccaagcaattcttctgttcaaagtcattaaacagcgaagtcgatgcgtggcaaggcgaaattttaacctgatgttcctcacagtgcgtacacccacaggaaggactaggaggccacacaatcatcgtcagaaagccccattaggcttaacagaggcaccaagaccagcagtggcatgctggggattggcattgggcgataaactgccattcaacgaagcatggccattaaccccatcaacaagcttgaattcatcttcgatttcagattcgcccggctcagagcgatcgtccttcttctcccctgtcgcgaggaatctgaaagcactacgcagcagacagtataaccaaaacaaattgatggcctgaaggacacccagtagtccgaaggtgatgatattcgagatccagcacttatactgttgagtctcccagttgagctcgtagggcccgacggtccggaactcggttagaagggaataaaggatctgaaggttcagtacgtggcgtagatatatccaggcgccgatcgaggttgcgtagaagggcatcattatgtctggggctatgtaatggagcgattttgaaacctggggaaattgtcaataggtgcgcggaatattttgggtcgtgtcgaaacctcgagaattgggttaggccaagggaatgcgacttacggcaaggaagaaatcactgatatcatgcgtaatataaacagcaatgccgatatacgtaaagtgaaagcgatagctgagcgcaataagcgctaatgtcacaacgtgatgcgtaacgagctccataaagtccttccgcggcttctccattcccagcagcataacgatagcctgctgtgcccaataagccgcctcgaacaaatagtaaaacttgaactcagcggcatgggtccgatgcgggaagagttcgtacatgccacgcgtgttgaagtaccacaccggcgtctggcgcatgacatacaaccccgcgggaccgaggactccaaagtacatcgcggtgtacatctgctccatgaagcgggcctgctttgtccgcgacttgatgcgcgagactgctagagggcgaataatttcttgcatgatgaattcgcgcgtgaaggatagcacgatcacgtagaatgacacgaatgctatgtcccacagacctttgccatactgcgtggaagcattggggttgtcattcgggggttcctctttgtaagagaggaatatgaaatgagagactgggtttgactcggtcgggttgagcgcgtacagtgagaggaaggccagcacgaggactagtggtattgtccacgtgtgcttccccgcgaaatgcctacagcgatggagaagagagcgaggcttttggggcttcgggattgagtctggtggctttgtatggccatttccaattgtctcgggttgcaagccattgatatttctccgcctaagggtatcttctttcattgtttggacccgtttaggggcgatgaacgggtgttttggaataggtgaagttgggatggaaaagtcgatatagttacctaagatatatgtcaatgacaaagacgatagttataacatgtaaaaaaaaaaagaaaaaaacaggctagtcaagctagttaaattagttaaattagctagttgaagctgaagccatagaatgttggactttccttattcggctagttcatcgtattcggatatctcgggccaaagagaatttcctccgaacaaagaaatagagaccacatatgtacctaggtaagagactaataagagactaattttactcgattccactcatccactctgtactccgtactgtccaggctatacgaaacagagagacttttgccagcaaaatatcatcctctatccgattatctactgactgggtgagaatgaaagcgtagtttgactgcaggcgccttggtcgtggcaccaattattttacacttaggacagggctgagtctttgtgttttgtatggtaaaccgggccaattgatatgtcataacatccatcagaagactctctcaaaagtggtctcggtctcacgggggggttcttcaatcaatccaatcggtttcctaaatattaggcgcacgggatatcctgtgatccgacagccctagcttcgggccgaaaaggatctggagtagtacatatgtacctagctaggtatcccggggaaagaaatattttggcttagtatgtactcagcgtgctgatatcagagcagctgccacgaggttctatagtctcacaatacagtcagggcatcaaatccttgtgatacacgtacagtacatccttgaaaccagtccaggatgcgaccggctgcacggtagtttcggcccccaagcagggatgctggtccaccgactagcatttgcaaacaaacataatctgcctccaaatctgcctccggggacatagtgcacattcttgtcataaatctatagctcggagaagaagtaatgcaagatatttgtatggacaaaccgaactccactttttacagattagctttgcgcttaaccctttcctacatagctacatgtaggcagttctgcctgcctacatgtctagtatgtgttttcgatttgtgcgtagagccaatgtactataattcaatgttgatacgcttggggatgcaaacattgaagccgtaatattacggaacttccaaggttgggtaatgattgtactggcaatatgattggccactcaacgaggacatccgaggtccatccgtgggagataacgttgatcttcttccccctatcggctgcgataacaatcttggtacttttgactctattggtcttcggttcattcccttgagatactcggtgctataacattatctcctcggaaatgtctgatattttgcgtggatcagctagctagtaaacaaggggaactccgcttgttgaggagagacgcgatgctcgcagaaccaagaaaacgccataatggtcaaccgcaggcctgcgaaccatgtcgcaaggccaaggttcgctgtgaccatgcaagcccgaagtgctcgcgttgtgtcttgcgcagcctagactgcatttatcaccctgctcccatgaccaagcgccgccctccgatctcccacacgcccatagagttcgacacaacactgcccgacctactgaccactcaaaatgtctccagctccttccagattcccactgaatcttccgttggggcaggaatccctccttcccctgcggatccgagccccgctgcgagttcggggctaacagcccgttctggcgcatcaaaacggaacatgttatttcaagagcagctgggccaacacgagacgacacgcttctctgctgtcttcgttgaaaaccaggatagctttggcgcagtgatgatcgatgccacgaattccaacccccacgagttagaccgagaacctgatgtaatggccaggtcccgcgtggagttggctgtcagaacactgctcaacttccccactgctcgtacatgtgacatgctgatgacagggattcatcatatctatgatgtgtggctgtctccaaccatgattcagcaatgcttgaaacaagtatggacagaatacgccagtgagctaggtgagccccggacacgggaatcagtatggagggtagcgaatgatttattcctcaaccacaaaaggcctcactcgacacctgactgtgatctctcgagtaattccgaccatgcttcgtggatgaactggtttggtggacctcatctgcgttgggaaatgatcgggatcctcttcagctgggctggaatcgcgttcaggtgcaaacaagagtgggacccggtattcgacctacccgagcagcatggacggaatcgcaacaccgccgcagaaaagatgagagagtgtgcagctgcctgcataaggctttgcgaagggaactttgaaatcagtgataccatggttatttgcatgaagaatagcaccagactacaaagcattatcatcagtgatgagagtgagtcgcaaacattcggataaattctggtgttatagaattgagctcatttcagcataggtgaccgtgtacgagtcgactacgggactgtccggagtgcctttataagcgcaggattgcaccgcctcaccgctgtaaaggaaatcactccattcttccaacaccgagcatcacttgcgtcgtcaatgtattatcatgacaaatgccatagtttgttcaatgcgcggccacctatgctcagcaaccgctactgtcaatgccccctcccactcgatttatgcgaggaagatgtatatgggggccgagaaagattggccgtggccattgcaaagcttgacacgaatggctggaacacaaatgggcagatattcacaacaagctggctaagagcactggcaatgcttagtcccatccgggagggaatcttggaactaactcttagtgtcaatttgaagtttacaaaatcgcaggtagagtacgttatttggaagcaatattcatacatttcgctaacttgagccttcttgcagagacctacaagtccagttgaggaatatagttgcttcatatcctccgcacattcagtatcaggggaactgtgaatggcactcacagtcaagcttgggattccatgggcggagcgctcatggggtctacatcatcacccggatacaacttgatgtattgcaatgtcagtttctcctccagcgcctacttgtagtgcagcaattcagtggtggccaagacttgttcgatatcgcccaagagacaatgtctgttatcctgtctctctggcaaaaccgcgatcagctgcaagaatttcaccacgcctttgactggattgtaagtatttggcgacccttgctggttacttgtgggaatacaataataactgatattcatccaggcagtatcatacggaatgccctgtgcgggaattttatgcgtcgagcttctccgagcaagtagtctagtgccacccgcacaactaagcgaactttcgtcgacggccgctgctcgcgactgtgttaaattctcgcggtcggaagtcgttcaaaatctggttatgttcagagccttacttgactggatacggcctacggataacaatgcgcagcttagcaagaagttcaagacagttcttcaaagaatcatcgatgcagtatttgattctttgggctcgtcgtgtggcatgcaaacacagatgccgagcgagcagcagtcccagggacactgtggtccgcaagaccagtctctaggacaagacgtacctactgcaacaggcagagagcatgatgttgactccgatatgaacacattcaacgatatggattggctgaacaccgtcgattggactcaaggtggttggcttgaacaaatcaatccacctttcccctattaagcaatctcaacggaacgagatttccaacagctcagtcttgaacgcatcaaaggttgtttattatgaattgcatgaaccgataagatggcccctgggtcagttcggagtactttttactccgtcggagtgggctacgccgggcgcgacaggggttttgcggggttgataagggccacggcgtttcacagttggaattgaataccgaagaatcggagttcgctatcttcattcccccatttgcaaaagtatccccatcaaatggtgatcaagaactgaacccctgctattatttaatgtcgacaaagcaggtcatcggatagcctagctcatcaacttgcgaaagttctcaaaaggccaacagcagcaataaagcccacttcgattatcatgtctccaaacgactctttcaatacaccccggcagcctgttaaaaatgcaactgtgccgttttggcaccgagacattcacgaattgcacgattatcggaccacagaggagcttccagtgtcgagtgacgtcgtcataataggcgccggctatgcaggagttagtacagcgtaccatttggtcaaaggagaggctagtgacaaggaactgtccatcacaatattggaagcgcgtggtgcctgttcaggtgcgacaggacgcaatggtggccacctaaggcctgacatgtatacccccatgaccaggctcatcgatcgagcaggagttgaacgcgcgttggaggtgaccgaatttgaaatcgcacatgtacacgccataaagtccttgattgaaaaggagaaaatcgactgtgactttacccttacaaggtctatcgatgtatggtccaacgaggagactgcccaaagggccaaggaaatgtatgacaagctggcatcttatgatctggagtacatgaaggatgtcttctttgtgcttggcaaagatgcggagggtgtctcgggtgtcaaaggcgcgaaagcatgcgcttcttttacggcagcaactctgtggccctacaaattgattctccatctgaccgcctcaattctcgagactggacgggtcaatcttcagactcacaccccagtggtgtccgtgactcggcaatcttcgggcagttttgttgttacaactccacgaggcacgacagtcgctcgaaaagtcgtctacgcgaataatgcctatgtctctggtcttcttccgcagtaccgcgaagcgatcgttccctgcaaagggctgtgtactcatatttcagttcctgagggcacaagagcgcctctgctaaataactcctacatagtccgtgaagaggacgacgttgtttcataccttatacctcgtgccgacggtagcattgttgtcggcggagccaacttgcgataccactatgttttgagttcatggtacgacaacgtggacgactcatgtctcattgagcaagtcaaagaccattacgatgattatatgcagcggcatttcaatggctgggaagacagcggggcccgtgtggataaagtctggaccgggatcatgggatacagctgggattctcagccccatgtcggcgccgtacctggggaggatggccagtatgtacttgcgggcttcaatggtcatggaatgccacaggcattcttgtccgctcttggagttgccaagatggttcagaatgggatcgagtttgaagatgctggtgtgcccaggctgtttcaaacgacaaaggataggcttgagaaggcgaaggacggtcctttaggtggggatatactcggcatcaagagatgagatatgtgtattgcacattaaagaatgataggtggagtgatgtagccgggatgttcttaggatcatctagtagtcttctatcaccaatgcaggctcccccttcttcgagatatagcttggtgtagcgatcacctcccgggttgcagaaagtcccactagtgacctcttaattataatatgctgtaccgagtccataagatgaccaatgtactgcacaagcgtctccggttgtctcagaccaagctatgagttactcggtgttaatacgtcgagccgctagttctaaacgagctcattgtaccttatctgtcggagatactttctcacggagtagatttctgcggcctttcatttctgcggagttgatcttcacccgcatttatcactcgtgtgctgctatctcgcaccacccagtcaacatttagctcaaaaggtacttgaatctgccgattgggtcctttacatcttgtatcttatctatctgccaataatgttctccatgtcctcccctctagctgttttctaatggtgacttcacagcgctttggccatcaacaaatatggctataagttgaagctaaatcgtctctggaggtatgtcgcagtctctatccaggaaagaccgcccaacattgccaataactattcgttcctacgagggtacatccaagtcaatcaggatgttcacgctcaagggtttccttggtaacgaggatcctgccgccgtccatgaattcaagaaagacgccaaatccacaatagaagatccggagtcgcctatccaaccagaagatgaatatgttggagacttcaaagaaatttcaactttgaggcaaggccttcatcaaagacacattcaaatgatcgctttagccggcactatcggaacaggactcttcctcagttccggtcgagcgatttcgcggtctggtcccctgggtgcctttttaggatacttggtcatgggctgtgttgccggtacggtaaccctggcgatgggcgagatgggcacgctcattcctttgaacggtggaatagtccgctacgccgaatactttgttgatccagcattagcgttcgccaacggctacaacgtagtatattcgtacctcgtgtctatccctgcagagattgtggccgctgctgtactagtgcagttctggtctgacctcaacagtgcgatttggatcactatctttggattgctcatgttgtgtaccgctttggtctttgtgagagtatatggggagctcgagttcgctttctctatgatgaagatcttgctgatcattggtgtgaatataatggtaagctcagcttgattcctacacgcatgacgggatttaatgctaaaaggtataaatcaggctcttgtgatcacctgtggtgggggtcctgaccataagaccatcggctttgaatactggcgcaaccctggacctttcgttcagtaccttggggttggtggtgctcttggtcgctttctcggtgtctggacatccctgaacagtgccctttacgcttattcgggaattgaaacaattactgttgccgccggagagacaaaatcgccgcggcaggctattccacaggcgacgaagcggattttctttcgtattttgattttctacggtatgctgatttcgcaagaggaagaatcctacttcttgttttccccagatctgacctctttcttttagtcatctcaatcttcatgatcggccttgtggtcccctccaatgagcctaaactcagcaactcgagtggaacagcttcacagtctccctttgtgattgcagccacactggctgggatcaaggtagtgccatcaattatcaatgctgtcatcgtcacgtcggcgtggtcttcaggcaactcgaacatgcttggagggtccagggtattgttcgggctggcgatgaacggccaagccccgaagttcttcactcgacttaacagattttcggtcccctggatcgcaatttcgctctacggtctgttcatgtgtctgggctacatgtcgctctcctcaactgccaacactgtgtttgattggctgcaagaccttgtctctattacaactctgaccaactggctcactatcctggtcacgtatcttcgtttctactatggctgcaagaaacaaggaatctctcgggagtctctaccgtgggcgacgccgctccagccatatatcagctgggcctcgctgtttatgctaaccatcctgctcattacgggtgggtactcaacctttatcaaaggacattgggataacgaaggatttgtctcctcttatatcaatatccctcttttcctgatcctatacttttcatacaagtttttccggaagacgaagatcatccccttggaagatatccccattcagccttttattgatattgccaaccgcaatccagagccccagttaaaacgaaagaaaggccttcgcagactgaacgttctatggaactgagcctggattattgtatatatgggatctgctggtcgttagtggagttgcgagattatttttagatcctcgggttaactcaacttaacatattctaactcgttctatgtgttgagtttacagatcgtgatatgtaaagtgcatgtagtgagaccgcccggggtatgaatggtagtattctcaacactatgtgtttattctacaccgacctttctgtacaattccaagtgcgtaatatatttcaagtctttcaagatttcatgacgaacaaccgaggctcctttatattatatctggaatatcccaccaaaagtcctattcgtctctaccgattcggccacattttatttccaagcctgtagcggtgggttcattaaactgataccccagatactaccgcgttccttaaatccggttctcgcatagagtcatcacagggatgtatgagatcaactgaaacaatgtaatcgtcaggtgacgtccctggcgagctccgagccggagtgggtctggtccgaagatacctgattacccgatatggttagtcccggagtacccacaccgccactgtccacgcatcatctctcgctggagctcacatgtacggagtaaatccattcttatctcaaccgcggaatggaggttatcggatagcggtgtgccggagtcagacaatgatgccaatagacttggcgaagggcattgaataaatgaccctgagaacgtcaggatcaatatgcatcccaagagtcttcagcctgccagttcaattctattcagtcagtgaaaatattgtatacacaacatgatctccccccagaagcatgccgttttcgatgtcgtcggcacctgtgtctcattcgactactttctcgacaccatcgaagaggtactcggcccgcgacttcgagcccatcaactgtcagccaagatattcggttttgcatggatgcaagctgctgagctcgagtctttaatgctccacatgtccaagcggaatgtgccatacaagaaagtcttcagggcgctcttttaccgcgtcttatatctttccgggatccaggacccgagatcgttcgcgaccgacgaggaaagagacatatgtcatgatgcgtattcaaagctggaactccgcccggactgccgcgccatgatggaaaagttgaggaataacgggttcaccatctggtgcttgaccacaggcgacacggaaagagttggcggctactttaagcgcgccgggtttgaaatgcccgctgagaacctcgtcagttgccatcagttcatgaagtatgagtccgcatgggagtctccgcttgatatggtcaaaccttcaatggggtcctacaagcccatgctgaatacattcgcccccgatgatcaaaagtggttcgtggcggcgcatatgtgggatgtgagcgcagctgttaaagctgggtaagttctgccgttttctcaaaacgaactagaaaggtaccctggctaacatatctcgaaataattagcttccgtggtgcttactgctcaatttacgagaaggagtcgtgtattgatatctttgatactaagatggatgtgatggccgagactttgctcgaagtggcggacaagatgattgccgtggcttcctgaattgaaatcctacctgtactttagagattcaagaaacagtttcgacatttcgacttgctgcatataccaatctcccggcaacattattataacttattattctacgcgagcagcgggcttccgtgacgctgcatagtatcatattttctaatgcgattacaagttcgaacaaataataatccagtggaacggatatttcctgcaaaatttggtaaggataaaaagagaaatctcacaagttcgcttgctatgcatattaaattaggcaacaagtggattgaagttggattgaaagatcttctcagaagacgagtaagaggaccttgtgagaatattgaggatcatcatgagagatcgacatgggtgcgcaagatcccggcgctaaatatgtagcaatgccttggaccatccttatcagattgatattattagggtattgatatagttcccaaggggtcccccttcgccccctatgccttcctaattgggtcccgctcctgcccaacacctatctagttctgcctgctctcctcaccgctccgcacttctcgtccggggaactccgtaccttactccgttgagccctgacttgcaaggttgccggtgtggacctggtccacaacatgtctcgaacatgagtccggatacggagaacctactccgtacggagtactttgaccagtatccattttattaaggtgagctgctggtttagctgctcttcctcttccaagatttgctcagggttgtgcggagcaagtccgtgggctcacctgggcaggtcatgagtaagtgggaccgggtcacgtgatgaacagacggcccgagggcgattttcattatgtaagactcgtaggcgtgctcagttttactctaagcaaaacgcagcaaggggacctcgggacaccggggtcggaaagctaagccttaataagctcttaggtagccccggagccgttttgcgagggactctacctggcagccgtctacactcagaagacattcggtatgaaccgcaggccccagatcatagcaaatctatttgtctcaattaagatcgagggacagccaagatttgccaaacattatccgatacagatgcaatctcgaggcagagagtatacctatgctgaacagaacaaacccggtttattttcggaagaaataagttattggagaaagtatgtaaacagtgttcggtgtgagacaatgtggatcaagcaaaaataagctcatcgagtaacatcgtcgggttttacctaatatttctgtggtgattggagtttgttggagtaactgaccatcttttattgctgagatcctttttattagatgaaatcctgtattccacagagctatgtcttacctaaatgttttccaatcctgcgtcggagttagtatggggaaattatcttatttagcgggacacccaaggtcgaaatcttcagtccgccagcttcaccccccataatcccaatatcccatcaattaaacacacaatagaaggggaaaaaaaatggttcaccatatccacatcgccgtcctagacgtcgatatcccagcacgcaaactatacgaggctcgtggactctccagtgcccacttccgaaccatcctccgcgagaccgcatcacgcctgaatgagaccttgttctctgagaaagaacaagtcgaagtccaggtcaccccatatgatatccgaggaggccattatccagacctatacaagctccgcggccatgcaggcgagaaccagatacccgtgcattcccctgtggatgcagtcttgatcaccggcggctcgcccggcgtatacgaaatggaccattcaccatggatgcaagaactcgagaaatttgtcaaaactgtttacaaccaatacccggaagtccgactcctcggcacctgcttcggccaccagctcatttcgcacgctcttgttcgcaacgtggaagacccggtccgcgatgtctgggttgagcaatgtcctctcggccgtgaggtcggaatttatactgttcaattggaagaggcgttcgtaaagtcgttcccgggtgcgcttggtgatcttcccgagggacggctgcgcattcaaatgttccatggcgatcgggtgatggccgttgagaagggaactgctgttacgcttaccgactcgccgccggtttcgctgcccgcgccatggattaacattggaagtacaccaatctgccctattcagggactttaccaccccggcagagtgctctctgtgcagggtcattatgaaatggatgtctttggcatgactaagatgtgcttggaatccgcaccggtcatgggatggaaggagtcgaagttggctttattcttggagcaggttggcgatgatagtgaggagagtcaggatgattctaaggcctttgcctctgctgtggtgtcattcttggctggctttgaacaatgacaggtgggggatgagaaatcccaaataagctggatatctgctcccagcacttgcggggtgaatgtgaatagaataaaattgcagaggaataaaatacacattatgcaaaatggtcatacctgagcaacaattagcactgtgcaatatggagtcgagaattcccgtcaaatctgcaagcaatgcaattcattatgtacagcgctgaacgcttctcaacccgccgagggaagcggggagagccatcgtggacttatgatggctaccttcttaaaaatgtcaaagccgcgatgcacaaagcatccatcccagttttcatcgttggctggatcaccggggcaaacagagccgagtggttcccagggatctcttccatgggaatttcgtttctcttgcccttatcccagagctctgggtcaattcccccaatgaaccaaaaggagcaaggaagcccctgggaagttcccagcgtggagaaatcctcactaacattggtccttggagtatcaacgtcaaagtcctcgaaatggtctgcgaaagacgcagccagttgggacgccagatgtttattattgtcggtgggcgggaaccgcctcgttggtgtgaacaagggcggtttcggcgatccactagcaacacactcggcctcaacgatgcgccgtatagcagaaagtattttctcccgagtctccaacttgacagtcctaaagtctattccaatttccgcccggtctgcaatgatattctccgtttgccctgcctgtaggctcccgaccgtcacgacagcaagatcatttgcgtccacttctctactcacaatgccctgaagcctgacaacaacatgcgcagcaaggagcacagggtctaccgtctgatgcggctgtgacccatgaccaccgcggccgtagagagtgattttcaagctatcggcagcagccatgatcgtgccaggtcgggaaccaacacttcccgctcgcattcgcataacgtgctggccaaagacgtaatccggcatggggattatcgaatagagtccatcgtcaaccatggcctgagcgcctccgccccgctcctcgttcggctggaacagtacgattaaagtcccgctccacgcattctgtgtacgcgccagaacttcggccgctgcgaggagacatgtaatatgcatatcatgaccacaagcatgcatcactggtttttcattgccgtccgcatcagacatagtcactgaactcgcgtaagggaggccagtgagttccttgactggaagcgcgtccatgtcggcccgaaggaggattgtcttgccagttccattcttgagaattcctacaagaccataacctccgatatttgtgtggatctcataggctccgagctgggacaaatgggaggctatcttttcagaagtggctttctcttgtagcgagagctcggggtgtgcatggaaatgcttgtagagagattcataaggagtcagatccacagcagcggtggctaatatgtccgacaagctttgctgagccattttgtggacaggcgacgatgtgttagggaactgcctaggtggtgaggggaaccgaggggagttggcgctgatatccgggggagattggtcagccaatcgttaggccccgggggcttctatctatgttgtaagggatctggcccccacgtctaggggaacacttgtggacctgtggacatcatgactcatttattaatgttgattgtggcaagtgtcctgccccaggaagacagagagcaagatctcgagagaatagaaagagaagttgccgattcaacaagactgcgagaaggcagtttcctgtttaggatcggaacgaactactaagaagtttgatgccccagggaccaggcatccgtcagtgggctacggtcactagttactttctttttctttttttttttttttaggctcttgcattgtgcctcttacttgcaccatagaagatggatacatatctatgagtttgaaggacacctgtacactacttgaaatgtcagtgacaggaaataatatcgccatgtcttgctcacttatttcgtgtaccagtttgcatattctaccactacatctctcgacttgagtgaagtgtgtaaggattcagagaaagcacagaagctggatacttcttgtttttcattgacatgatccctattaatatggactgataaatccgccattaccaaaccgaactatatatcacacacatctgaccaaggcaagcaaacgcagcaaaaaggagcattctaaagaagtggcgcgaaagcagcccacaaaagactcattaacccaatatgagggatacttatagaccctgccacattgaaggctggagaagatgtagagggagttgctgaactagtcgggcttatgcgaaccgagctcgatggaatacgggaagcattgtcagatgtgttctcatcgccaccttctgtgccctgagtacttggcacggtcttgattgaaccgggcaatgatgttgtaataagcacgccagatactgatgtcgtcacaatcggtccaggcactgagctcgtcacgagggagcctgaagttgatattgtcacaacagatccagagaaagaagtggtcacaagtgaacctgacaccgaggttgtgacaatcgagccggaagccgaggttgtgatgggagtgactggctgagttgtctctactgggctggatctttcctccgtcgcagtggtggtagtgctcgtggcttcagtgctgatggtttcggtgctgctggctttagtagtgctagcgtgtgtattcatagtactcgtcgttgtagctgctgtcgatgcttccgtgctggaagtagtggtgatatgggtgcttgtcgccgtagtctccatttcagtgctggtggcactttctcctgttgtggaagtgaccatgtcggagcagaaattcagccactgtgcaaaggtcggcaacatttgggatgaatattggttagagtcagattcagcattgttggtaatgcattgctcgcaaacatccaggttttccatgaacgccgagtcactctcgcaaagctcaggcgtcttcccaagcacttgtggctcatgtgcagcatcattgcaatcattgaaacaaacagtagggatgttcgttatgtcggctcttttcatctttttggcaacagcgaagtcccataaggacatgtcgcgcttactgccccctgcaactggatcttctgaggactggaagatagagtaattgagaccgaagtcctccgggttgagattgtaataaattttggagacattgtactgccaagacggatgaacgtctagaggcggagccacaatgcagtctgacgggctgcagacgtatccggggtcaggtagacctgcttcgacattgcattccgaacggtcgcctgtgtgacgtggcttacagaggtacccgggtgcacagccccaggtatagtcgtctggcaacacggcggggggcgtgtaggatgggttgctgataaggctagggcatacagaagccggtaccgtcgtggtgctgctagacgtctgggttgatgtggtgccaggcccggtaacagtggctgtactaggtggaaggaccggtctggttgtttttgagtctgatggtgttagctgttgcgttaataattcatagtttgtgcgtgacaccatacctgggatagtgacagtatcggtaatggttgttgaatcaccgacagtcactgtacttccagggaccgtgacagttgtcgtaagggttgatccaggcaaagtgctactaccatccgatatagtcacggtggtggcaggctcagtaatgactgtcgtgacagtggtattggggatagtgacagttgaatgaccggtagtagtcacggatgttgtggacactggaacggtggtaacactttcggagctggaagtggttctggttgtcactgtagtggttgttggagtcggcgtctctgtgggggtggtagtggaaccatcactggtcatcgacgtcgttggggtagttgtcccaggtgagctgggggtagttgtgggtggtacacttgagctggtagtcccaggcacagttgcgctagttgtcccgggtacgcttgaggtggttgtcccaggctcgctagaggtagttgtcacaggtacgctggaggtcgttgtcgaaggtacagtggaggtggtcggcgtggcagttgagtcatctgtgcacgagcacgatgtcctggtaagggtcgtgtaatctgtgaccgtttttataggtccatgtccgggtggtgctacggcggcatttgcagaaacatccaccggtccaatgccaacatcggcaatgagactcagagtagggccgcttcgacaaccacttatagtcttggtggtagcctcagtgatagtaattgtcgtggcacctggagagacatttcccgtctgcgtcgaagtctccgtgatagtctcagcggtgcaagactcgccatcaccaagccaaagtgtgaccccaactgctgctgtgacagtcaatccatccttttgttctgtttctgccggcagtgcaggggctctgtttattaaactgccgtcacttgttgtcaccaaaccgaagacagtcgccaacagcgacaaccaagagaccgcgtgcttcatctttgcctgtctgtagaagaaattcttccggggataggcagaaggtaaacaagctaaacaaagaaaataactcgagggaatgggaagacatccaacgcatacgcacggcccctttgctcgatgaaagaaagcccaatagttcgaggctcaaaatcctccccagctgggcatcagctcggacaacttaccataggcccatctcgcgaacgcagtttacggggaaaatacataatattccgagcttttgcaattatgcatccaattggggcctaactggagcacacaatgtggctccttccgttgattcggttgtatttcccgtagctgcatgatccaagccatgcagcaatacaatcacggtaatgatcagaacggtcagaccacgagtttagcggtcgcacctgggcaatacacgtcgtttattcattcatatttctccttggccaagctgcttcgtatttagggcgggggcaattgacaacaaagaagatcaacaaagccgcatcgcaagtgccgccccccgccccctcgctttttgcattttgtcgacatgtcagcagtaagccagagccctcgatggaacctgttatttgcaaattgtgacaactcagtgatgagattaaccgcctatttcgttgaaaaatgcgttttcttttggggacgctgacgctgctggtcgtgatagactgcgcagtggccgtatgtagcacatttcagactcaaattaatgtttccatgtgcagttggcaaggcctgcgtggtaagtgcccttttatcattttcagacaggcttttgttttactgacacaggtagccaatatcctgcgcgacacagtctatctcgatggcgggaggctatggtatcagaagtatgaggctccccatggtcaatcccaaattttctctaacaattgcagaggatatgatgatggttgcgtccagccccagccggataacagtaggcacgaccaagtacatgttgagatatgtacatagctaactagaagcagatttggaagcaactatttattacctgaatcttacgaatcccttcaacaccaaatctgatttcatgatgctcctcagcaacatgtccgtcgccggcggttcagctagcatagctccgaattatgttgacggcacaatgttcgccaacgacaacgagttctatctctatgggttggtgtccctcatctcctcttctaatgagtcactgattctgagtcttttgttgcagaggcatgctttctaataccgggagctctgatcctcctcctggtaatcaagtcctctcctacgctgcgcaccagtatggcacctatagaagctcgtgggcgcccaactggaaacaagaatacctacccgctaatgtcacacgatacatcacgaatggtggtgccgcgtcggctccgagtgaaaacctaggcttttacttcagtgggatgcgtgcgccggactggggtgacttcaatttaaaccaacttcaatctaaccaaactgccgacacgctaatcactctggacatgtcagtgatgagcgacgggaagtggacgaacgacacactgcctagctacattcctactcgttctaacgcggaactggtctgggtacctgtatccgagtctggagttttggtggctattggtggagtggttgaacccattcagtttttccggaatgacaaagcaaactcatcacgaaccgccgagagccaaacaattagcccaacgtttatggagacggtttccgtcttcgatgtcgagagtaaaacctggtatctccagaacacgacgggtgatataccgccgcagttgaccgagttctgctctgtgcttgcgagtgcggctgatgggtcatcccataatatctacatctatggagggtacgatggcctcgactataacgctaatccttcggatgatgtctatatattgtctctgccttccttcagatgggtcaaggcatacactggtacgaacacacacagtcgcagcggtcatggatgtatcaaagtatatcctgatcaaatgctggccattggaggacagcatgtggactcaactcattgcttggagggtggtgtcatagtcaatttcaacctcaacaccttgaggttcgaggatgaatatgatcccacaaaatggagtaagtacaaagtgccagacctcgtgacgaaatggataggtggcaagtgagtatagacctggcagaaagcaaatcgccgtgactgacagctttattagctccgaaggaggtgcaaccactaccaccccatcgtcatggaccaacagctctctagagggaatttttggcaaaaagtatggcaagaaggtcgagacatattggccgtacaatagcagcaacagcagcagtgcctccgcacaagatcgcagcgggggcagcggatttcccaactgggctggtggagtaatcggcgcggtcttgggtctgctcgtgatcgcgatcattgccggactcttcttttatcgccgacgtcaccatcaacgcgagtctgctgaagctgaagccgaagctgcagaggctgagcctaagaaccgtcctgcagaatggatgtatgccagcggcccagcctcccctggacccgggccagtatcttcatcgaccggcatggagacggcggagacggtacggacgacgcagacctcggcaacgcagccgtcaataacgcagccatcgataacacaggcttccactgtgccagattccctcgtctcgcccgcgacccctggcacggtggaatctgggggagatgcgctgtatgagatgcatggtatgtcgatgacattattatttgttccccaccagaaaaatagatactgcggagtacttatactgacgtttaccagattcatcacctgttgaacttcccacaccattcaacaccgccgtcttcgctcacggcgggccccccaaacccgaacccgaaggtgggctcaaacccgacccgagacgaggctcccagtctcctgtctcgccgcagactcctagtgagacggattcggagttctcctattcaacgggccacaacaggcgcccatcgtcactgtcattggcatcgccattgtcgattgataacgtgatgagcggtcggtcgtcgcatttttatgagtctttcgatagtttggatgtccggcgagcaggtcatcgttctgagttctcccagatgactgatcatgcggaagagaaggggcggaagggaggtagtgagacgattcgggaggatgaatagcatatagttacttaatgtggtaatagcattttcgtatgtagaatagagacattggtcagttagctcgtggtgaacaattcataataaccaaagtgactggcagcactaaagtacaatcagaatacacgcccaaatcaagccaatatacttcgtctgcctgcattctgggcatattgacctggtatatctggcccccggccatgcgcagcacttgcagccaaagtggctagggatgcaggtatctcaaaatgcttgttgatagctgagctccgtggagaactcggttcccactgtgtgttaagtatattgactgttgctcgctcggcaactaacggtgatccttgatctggaagaatatgtgagtttggaaccacagaagacatgcactggcgataccttttatcaaaggttgagaaacaagagcaggctgcccatccccatccccagaaggagacccgtcacccttgtctcgcatactccatcttcgcttcgaccgtgggggtatagattctctcacgggcttgtcggcgcctgaatatttcccccgggacgcgataccagccccccagcgcaatctgatctcgtatcccccgcaaatgaggcccctggaacagcatttttggcaggctgggcgcgcttcatcgcactggatcctccttttcttgcagctccagcatcccttgaaggaacgatggcggtgggagatgtccttctgcttctcggtcggaggcatgttactgagaaactgactgggaaggcaaacaagaacaagggcataaatacccaggaagttctacaattcactcatatatactcatgcgatcgttgtgctatgcgcatcctcgcactgtgattggccgaacaaagatctcagtgagggaaatagtgcattctaacctcctatggggagtgctccccgagttattggcaaggagatgtttcaattaattgcctcgcttcttccaaaagatatctcatgatctgtgtgaaggggagttcagtttaaaagtcgatcggatttcaatgcgggcttgccgtttttggaaggtccacgcaggaaaacgaccttggaagtttgtcttcttcagcctctccgacatttctcacatttcaggggatcgaaatctgccctgaaagtgaagatggggcaataatcaactctgagggacaatatcgaggttttgcgaccgttatgtgttctgaacactgggggcgcagcagccacattaacccgactaaccccgatctcgggaggagttgatagctgtgtgtcacggaatcgggcatcaaagcaacttccccggcaatctcttgagtcggatatccagcacatcgtcaaataccgttggtatcgtcggcacttcgcataacaatccgcatctaccttccagagggggaatcttcagcctttgtggggtgtggggtaaaggaaaaaaaaactggagctctacacagacgtcaaatatgtttcgcctaatcgtttaaaatgcctccaggttttggatctactatgtgggccacgctcggtgaatctccagtagaggtgcccctctgtatggccacggaggccgatgcccatggggttccccaggagaaaatgacaaaagcccaggtcttgtgaatggggttgcgggacatccagtttccctaattgccccagtgaccccattcttggatccaatatatcgccttcagaaggagtatacagtatacagcccagagacaagtgcttcattttcacgacagcgttaaccacgttgttgggaaatgagtctagagtgattactctaaacacgtcctttatcctcactccaaactccccccctacctcactatggacgtggagaccgacgaaactctcaaaccaaccgaccaaagcactcaagatgccaacgacctcgcccaattcggccacgagcaaatcctcgcccgcaagttcaacatttggagcatgctagcgttggcattctgcgtgcttggaacatggtcgacctttgcacaggatctctccgacggtctgattaacggtggccctgtctcaatcctgtggggactggctcttgttgcattctgcaacacctgtgtcgcgctctctctgggcgagatctgtagcagcatgcccacagccctgggacaggcatattgggtctaccgtctctgggactcacgcttcggacgattcctctcgtacatgtgtgcttggattaatgttttcggatggtggacactggccgcctcccaaatggcattcatgaccaatttccttctcggtatgaaggttatgttcagtccagcctggactggtgcgtcgacggggtggcttgaatttgtcgtttatgttggatgtgtcttcgctgtcacactgatcaatgtgatgggctgtcggagggagaaattcctgccctggctgaacaactttgtcggagtctggttctttggactattctttgttttttgtcttgccctgcttatttcagtgggcacgaaagaaggtctctcgtaccagcctgcctctttcacgtttggaaagtggattaaccaaactggctggccggatgggattgtctggttcattggcctagtccaggctgcgtatgggctgactgcctttgacgccgttattcacctggtggaagagattcctgcaccccgcaagaacgccccgaaagtgatctaccttgccgtgatctccggagcggttagcgggtttatcttgatgatggtgtgccttttctgtattcaaacggtgaatactgtggtagactcgcccagcggcctaccgttcatgcaactcgtccaagaaaccgtgggtcagagcggcggtgcagttctaattgctttgttcatcacgaacggcctaggccaggcaatcagcatcgtcaccacagcatcccgtctcacctggggctttgcccgggacggtggactcccctttagcacctacctgtcggacgtgagtccttactggaaagccccagtcagggcactctggttccagggaggcattatagccctggttggagttttgttcctgtttgcagagacagttttgaatgcgatcctcagcgtcagcaccatcgccctgaccatctcgtacgggctgcccatcatgactctgttgctgatgggccgcgacaagctcccgcccggtggccagttcaaccttcggagactaggcgcaccggtaaactgggtctcccttgtgtattgctgtgtgacaaccgtcttctttttcttccctggcgcgcccaacccctcgggtggtgatatgaattacgccattggtgtgtttggcgtcatgcttgtcatcgccgtgtctttctggttcgtccagggcagtcgcacctatctcaacaccgaggagatgattcctcatgttcttcaggcccatacattggcgaatgatccacttcctgagccaaagaaggaagaccgatgataggtttctgtgaatgaagttggtcagtacctccatacagaatatgtgatttgcctggggaactcggatttatcaggttgagtttttggggatatcaatagggtatatatagacatagatgctacgtttatatagaacagctttgaatttgggttagacaaatgtgttatcgattgagtactcgatgagccacgtagagatgtagaaagagatggttaaacacagctacgtcagactgcatattgaatgcgagagtggtaggatccaggtactaggaagaggtatctatctgaataagagtgctgtgcgaggaagaaacaaccaaccttgctcatttcctattatctatcagccaccctacaaccctgcgagctcaagaaccgcgaacctttttgatagttgaagtgctaactcgacctaaatagcttttcaatttttactagtaactactaggacgtctccttgccatacctgccgtcactagccaagagtcaaacttgttcaaagatcttcgttttcgactcctcgatatttttcagtctttctagtagcgcctagcgactactagcaatatcttattgtcagacacctgacaacctgacgaccgaaaaaaatcgagacttttgagattttgacaatgaaattttgacaatgaacatttctggttgttactagtaataaccgatattagatgcactagttgtccaggggaggaggagtcaaggacgtttgcatatattccgcgttgacttcactatattctgctcatatttcggtgtcgttatggtcatcttttccagtctccaggtcaattaacaacctggagaggtgacagaatttgagggctcagagaaatcgataccagcgacctcctaggactatgtactacattgttactacaaattatacttctaacaatgagttattaccgtacataactagcaaggaagaagttgacctattcagattttttttctttggtcatcggtgtcatacgagggaagtcctctatttcctatgtacaatataatatatccttcctagattcaaaagcccctctagtcctgtcctcaaagcttagatttcatgttcacatgaatagccttaatattcgagtaagcagcaagaccggcctctccaagctcacgcccaataccagattgcttcacgccaccgaatggaatgcgccagtcgctatcgttgctagagttaatccagaccataccagcctcaatcttcttagccacgcggtgtgcgcgagtcaagttcgtcgtgaacagagcacttccaagaccataagccgagtcattggccatctcgatagcatccttctcatcgctgaaccgggtaatgaccacgaaaggaccaaagacctcctcttggtagatacgcatcttgggcgtgacatcggtgaaaatggttggctcaacgaagaagcccttgccgtcaccaacaccactaaaaggcttgccaccagaaacaagagtggccttttcagactttccgacatcgacataagacatgatgcgatcatactgagcctgtgtcacctgtgggccttggaaggtggactcctcaaatggatcaccaaccttagagacattcttcacctgagctttgaatgcctctaggaaacggtcgtagatctcgtcctgtactagaatgcgggaggtggctgtgcagatctggccctggttgtacatgataccgatatgggcccattcaactgcctgttcgagatccgcatcgttgaacacaatcagtgggctcttaccacccgtctctagggtggtattcttcaagtttacactggccatcttcataatttgcttggctgtggccgtgctgcctgtgaaggcgatcttgtccacgtccatatgcgaggcgagcgcagctccagcaacggcgccgtgcccgttcacgatgttcaccacgccgggagggaagcctgcttccacgatcaggttggcaaggaagaggattgagaggggggtttgctccgctggcttgagaacaactgtgtttccgcaggccagggcggggcccagcttccaagcagccatggcgagggggaagttccatcttattgtcacagttaaaagttggctttaagtactattaggggtgaatcggaacttacgggataatttggccacagacaccaacgggctcccgtacggtgtaggcgaacttatctggggttgtatcgatgacctggccaaagaccttgtcggcgtatcctccatagtaacggattgtctcagcggtctcggtcaggtcgtcgttgaaggaaacggagtacggctttccattgtcgattgtctcgatggtggcgagagtggcacggttgtcctcgatgagctgggccaggcggttcatcaacttcccgcggtcaatgccgggcagatcgcgccaacaggggttattcagagcagcgcgagctgccttgacagccttatcgacatcctgggcggaagctgcgtggatcgatgtgatttcttttgcagttctatttgaccgcccgtcagttatagaattaagaggtggcatccgaggttctgatttctcacgtacgtgggattgatgctggcaatcttctcaccagtcgaacatttgacccattggttgttgatgaacaatccggtgggctgggtccaagtgtggccgttaggggctgttagttgaacggacaagtcggccatgattgtatgtgctttgtactgtgagtgtcttctggcgagagaagatggtgaagctagatgagatgaatttgtaactaattcttaaacccaagcttagctataggaaattgcgataagtgcttcggctggacatgccattctaggcttatcggatgcatcatgatgaaggtaccccacagaaagatcgacctccagatttctgaggttcaaaacggcggggtgtttggtgtggatagatgtggatagggtacttactccgtagaggtgtggattaactggcgttgataggcccactagtcccaaacaggcaagtccacccatggctgtcgcattcagtttcattgttgtatagtatcttcaatgaattgctcttccgttcacattcgtgcaaatatctatctcttttctttttgctatatacatgtagtatggtgaaaaagatccatatacaatagaactgcctctatggactctccaagcccctccagggctgctgtggaggcttacatcatgcccatgtgcacggagtaaataagcttgatttaacgtcttggcatcgccaaccctgcccagccgccttctcccctgatttgtctatcagatcagatattttcggattagggtaggtctagcctagcgttgacccacggtcttttctacaagacttgccttattaggctggccactagcaaatgactggccaacacatctcgccgagccgttgcaatgcgattggccgcgattggccgaataatttcgatggcaaacgctttacgcaaaataaattatggcatagaatcaaagtctcagacatgttttatgcaaacacacatcttctccaggctttatcctaaatcgaacaacggctagagtacccactctcgggacctttcgctcactttgcccgagtttcttatatcgtagatatagcatcccgattacccgactaggaaggtacatgcgggcaaattcgatcagatattcaaggtccattagctatataaggactattcgcaggttttcgatggagcttctggttttctacaactctataactccttccttccccttgataccccttccacatcttcatcatggcgtctgcacctgataccgagtcaattcctggctacacaatcttccgtgagggagactatgaaagcgtcgccgctgctgccatgttgccgcaaggcacaccccacccgttaggtaagacatgtctctgcataaattccgagagcactgctaagtctgaattctagatcaactttctattaaggaaattcccgaggcagcgaagatcatccgggattatgccaaccccaagtctatcaaattcaactgcctcacactccgtgaaccccgaaaagcagagtaccgtgcgttccgtgctggcgcagtcccagctcctgcccgtcgcgctttcgccattgtcattgtgcgcgaaacaaacaagatcgcagaggtggtggccaatcttgccaccggcaaggttgaggaatggaaggacgttcacgacgtcatgcctaccctcaccctagaggatcttgatgtgatggagcgtgttgcccgcaaggatacccgtgtcatccgtgcctgcaaggaccttggaattatcgacatgaacaaggtcttctttgacgcatgggctatcggcatcgacgagcgctggggatacgaccatcgcctccagcagggtctggcttactaccgtagctctgattttgataaccaatacgcccaccctctagatttcagtgttgtcgccgacactgacacagaagaggttctcagcgtcgacattcgctacgtaaacggcgagcggaccgctacccctctcaaggaacacaactacctccccgagttcatcggcgacaagtacaaacatgatcgcctcaagcccattgatatcacccagcccgagggtgtctctttcaaggtccgcggcaatgagctcacctgggccaacttcaagatgcacgttggcttcaactaccgtgaaggtattgtcctttccgacgtgcgcacccacgacatgtacgaggaccgtgagcggactctcttcaaccgtatctccgtcgttgagatggttgttccctacggctgccctgaaaaaccccaccacaagaagcatgccttcgatgtcggcgagtacggcactggtctgatgaccaactccttgaagctgggttgtgattgcaagggtgccatccactatatggatggtgttatgtcaacctccaagggtgaggccgctgtaattaagaacgctatctgcattcacgaggaagacaacggcctcctctacaagcacaccgacttccgtgacggcacagtaatctccgcgcgtgaccgcaagcttatcatctcccaaatcatcacagctgccaactacgaatacggcttctaccacaccttcaccctggatggcacctacaagctagaggtgaagcttaccggtatgctgaacacctactgcatgcacccaaccgaaaccgctgctcccttcggcacggaagttgccccctccatcaccgcccacaaccaccagcacctgttctcccttcgcatcgacccggaaatcgacggccaaaacaactctgtcgtccagagcgacgccgtctcttttgaagcccccgtcggctccccagagaatccctacggcaatggcttctacagcaagaagacaccccttcgtacatctctcgagggtgccgcagactactgcttcgagactaaccgctcgtgggacatcatcaacccgaaccgcatgaacaccgtcgccaaaaagcccgtcggctacaagatcctcaataacaactgtccccccatgctcgccaagcccggaagcaccgtctggaagcgtgcagccttcgcccgcaagcccctctgggttactccttacaaggactacgagctcttcccagctggtgactatgtctgtcagtctgacggttctgagggacacccttacaacccgaccatcgccgactgggcgaagcgcaatgagaacatcgagaacaccgatattgtctgctacatgcagttcggcctgacgcatttcccgcgtactgaggatttccctatcatgcctgctgaaccggttagcattatgctgcgtgcatcgaacttctttgagaagaaccctggtctctgggtgccgccttcggctatttgtgtcgatacccagtcgaaaaatgcgttcccttcttcttgctgtgccacaagtaaaccccgcatgtgagggtcgaaggaacgacggcattgatttatggtatggtgtttgggaacggggatctttcagtgtgctttgtcgtacatagtaaatagtacatagtcttgccctttttctgttaatattaaattgatttttatcaaccttcccttttggttctgatcgattattgcattctaagtgattctatggagtttttctgcaatttgtgtcatgggatgtaaccttcacttcatctatgcatatgtatatgtactcataaaatctatcagacaagaaagcccagcagtcactatctccaagctcaaatgatgttcttcagctcctgcccagcaagaagccgtctaaggttatacgcaataagcgcctcagcctcacgcgggcgtccaccagcagcatgaggcgatagaatgagattaggcgcagcataaagcttcgactccttcggcagcggctcagccgagaaaacatccaacgcggcaccaccaatgctgcccttctcaagtgcatcaagcagtgcatcctcatcaacagaagtcccccgtccaacattaacaacccaagcgtggctcggcagcaacgccaagcgctcagcactaagagcaccattggtactcgctgacccaggcaaaatcataacaagggcatcagtcttggacagaatctctggcaagcgatcctccgcgacaacctcaaacccgtgacgtacacccgcactccgggcaacgccggtaacattagccccgagggcagtcaaaacgggcgcaagggtcttggcaatattgccgaaaccccagatagtaacattggcacccttgagggtacggaaagtgcctggggcgcgatcaggctgagcgccgcccagatgggcgggccactcgccgcgggactggaaatcgcgcatttcataaaagcggcgggcagcgttgagtagcatgccgagagtatgttccgcgactgtttcgtcgtgcaggccggagccagttgtgatagcgacacgggaagcgtcaaagcccgcagcgagcacgtcatttggaccggctgctagcgactggatccagcggaggttcttcatgcgggaggctgcgtcgcgcagattcgtagctttgttgctccatgttacgaggaactctgcatcgattagggattcggggattgggagtgtgacatcgtaggggtgcaattcgacggagaagccttccagtgactttgtgtcgaggtagagggaggttgggtagaggagtttcattttatgggcgggttggaggtgatttgttagagtgtcaaggcgttgtttgggtgaggatgacattaagagggtagtcaaggttcttatgcgaggggagagtgacaaacctgtggcaacgcggggtgtctcggcggagatcccgccgagaccggggtaactccgggaaagcacagatgagactgcggtgatcaatgaaacttatcaaattctgtctagttccgataaactatgtatagaacgggctacaggtattgaggtgcatacgtagttcataaaattcgtaaaataccaagtctagaaattcagctttagaggcgtactggtcataccaagttagcttatggctactgtgttaattaaagctgtgctaccctcgtcctctaactatgcccttgtccgtgagagtctacgtcattctctagggatcgcctcgagattatatggtaggtgctaaaattactatagggatattatgatagttaccggcttgttaagaattgtgtccagcagatgtgtgtccttctcataagagaataccaacttaaagtgaaagtggagcgtttctggtcctgcctaggctggggggatggctgcttcctaacttagagctgtgcgggttgtggctagctgatctggagaattgataccgtaggtggtcacgccgtcggcgcaacgtttgttcagggcggccagagccctgcccgggccgcattctaccatactcaccacgccatttctagctagagtccgcacacactcgacccagtgtaccggcttgtatagctccaccattaggtcctgcttgagcgtatcgaggtcggcagcgacggtggcggtaacgttccgcaccaccggcatatgcggcgtcatccactcgacgctattaaccatcgcagagaaacggccggcggcgggtttcattagggcgcaatgcgacggcacgttgcccgccgttggaacaacacgcttggcacccttggccttgcacagctcagtggcacgattcaccgcggctttatggccggcgatgacaacctgccctggcgaattgaagtaggtcacgctaactacttggcccttggccgcttcaccgcagatggcgaccacgtcggcgtcctccaggccgaggatagtgaccatggcgccatcattgagctctgcagttgcctgcatcagccgagcacgagactctatcaggcgaactgcagtgtccagcgacaagctgccggccgcgaccaaggcgctatattcgccgaagccgtggccagaaacgaaggccgggcagggaccgccattttccaaccacagacgccacagggcgatagatacagtgaggatcgccggctcggccttctctggttgatcgagttgttcttgtggaccttcctggacgagtgcccacagattgtagcccagggccttagaggcttccttgaaggtctcgaggatcaccggattttcagcgccgaagtcggcaagcgtgcccattgatagggacccttgaccaggaaatacgaacgcgagggacgtagacatgattgaacaagcccttgttgtcttgtcatcggatggggtgtgtcgaacacaaggctggacgcggaaggtgaagacttgggtaagagcgaggaccaaacggtcatatttaaccacttcgagacgaatctgcagctggcaaaaataaccaaagagcgggggacaaacggagcattcacaccaggactatgtcgacaattgtccttgtctgagattcacaatttgtcaacctctttgcgtggtggcccgtgtcctcagtgacgtctacctatggtcacaattaccggggagtccaaagtccaaaagctcgggatgtcacgtactatattatgggtagacgagaggcactcgagctcccctcagatagtaggtagatagagacaatgtgcacaatgggtatcaatcaattcggccacggcctacaaaaaaagctatatagcaaaagatatacacagaaccagaatatatacgggggtatcatcatccccagcaccaacttcccacctacgacgcaccgtctttctcaagaggaatctcgggatcaccgtcgacggcaccggtgcccgacaaaaagaactcgagctcactaggcccaccctgcgagttctcattttccgcgagctgttccagtaagctcagaaaagggtctttctcagatgtgccctcactaccggttgtggtgtgggtggcactagtttgggactgagcacctggtgtcagggcagtgggaccagattgtggcattccgttcatatttgcatgggtggtgtcgaaggggaaggttgcatattgtgggtttgggggcggtgttggcgctacgttgagggaagcgtcggtgagaaaggctggtggggagaggccgaatgccgagggggagaagcccggaatggagaggtgggtgttttctgatgtgccggtgccggataggtccgttccggttggaagggagaagacggagggcagggatggtgattgttggtgttggttgctttgaattgcgtggaattgaagggtgggcgagagcggggccagatgagagggtttctgggacagagaacggaaatgggaatgggagttgcgacggtctatatctgagccctgggtggatgctaatggactcgagggcccaggccgtgtacttgagaagtaggacgaaggattctggtatgacggtccggcggttggccgttggtagtagttatgttgacgatcgatgaagttaacagtactgtctctagagttagtgatcatacgtataaagaaaggggtggtatcagcaggcgacccaccttggcgctagatcatccgccgcatctataagccgaacgtgtgatccatccaacatcagaccgggatatcggtcgaggaagtcttcgagatggaaaaccggcgagaaacgcattgagctactggcaaggttgcgcaccaattcagagtgacacgtatagatagtttggagcagctcacgctgatgctgcacgccagtccaaatattgcgcagccaagcaagctggttcatctcccgagtcaggaattcagcactagaagagaaaacctccccttcgtggcccttgtagtgcacgccgtgaacatgcacagtccccgctgtacacacacagtagctgacgaaagcaggccactcaatcagcggagaattacgacccagttcaactagctctgcgatggcattggagtgcgaaaagcacaagttcgttgcctcgatttgccaagactgatgctgccccgtgcctcggagctctaccaggtcaattggtaggaatgggcggtagatcaaacaatgcaccaaatggtagatcagcttgctcagcaagagtgttgtactctcggggtggccgaacaatgcatcgatggacgcaaagacgtcctgtgtaccagccgcccaaatatctagttcctgtcgtatcttggatagattagaaagcgcgtgccatgggaagtgagagtcgcctttgactccaccagctgccagatacttattagtgacaccaagaatacgcgtgatgtcaatcaacaaagaggcagcacttggggattttcgtctggaatccgcagaatattgaatgttcggaccgacatggaaaagctccccctccatgtccagaccagctgcgtgtggcgaccaagacggtaggcgcagaacaaccgaatgatcagtgatcagacatggacgccgagatccacaattgataaacctgtccatcaagtaaacagaccagaatagccgacgtctcatttctcgctcagcaggtgtgatattaggcttagagggtgcttcccggtacaaatctagggcgacgatcatggccacgcaatttgctgatcatcattagtggggtccattaaaccatgtcagatcgcgaggaaagcatacagaatgtcatgtaagctttctttcccaacccataggcgtagaaagcttgcgaaaccaacattagagtctgcagtccttctactgtaggattgtcgatttcaatcatgcgtcttgcttgtagcgctgcatcaagcttggtacgtagtgactgctccacttgaccaggtaaggttgtgtatctgagattcgtcagtcaaccatataagcatgtgacaggacttgaaagctcggtttttacctcactgtcattgctgagatagccatggccagacacggcggcaattggttcagttgatggtgttgtcgcgttgtcgcctcgtctagtacataaaatggcttaccatgcaatcgttcaaagtaaatgtcaaggattgcatccgatagaggtccattgtttgttggagatggctgttgcagaagacttgctgagtggtctgccggcctagggaagggatccacatgttgcgagagagaagttggcagagcggatcgatcgcttggagagtaaatattaaaggagttgtctatagtgttgcgacgggtgggaaagctcggcggatcgtccggggtatcgggcgaagtgggtgaaatagggttcttttcatcgtggagtcgtttctccaacccatcgacccgcttgaggagagcttctagcacatcggtcttgggccccctctttttagggacggcatcttgaacataagatcaacaggggaaatcatgtgatgcggaagagaaatgattaacataccatatacacatgggcattggaagactttacatgcctcgcagctcggtcgcatgcgattacatttgatctatgacaagttagacacatccaatcgcacctagactgactggacaaaccttgcgcttgcgacaggacttgcagttcatggtttcgcgcggctcgaccgtcgcacggcggggcgtgagacggtcgatgctgacctgaggacgagacatggcacatctacatggaagagagagatgagaagaagaaagaaaacggccccggccaagatggataagaagtcaggcgcatggctgtggcgttaaaataaaagggaaagcctataccacgcacagttgcggagagaaagaaatgcggagaaagtgatgtgccgccggaattccccagtttgggctgacatggggttattatgtccttgtgttttaattacgcatgatttaggctattaattacttgattataatatcggaacccctatattatatgtgtatataatgatattcttattcttatgaaagtttactctacttctaacatcttcatctcagaaaccaatgctcctcccctttaatctgtacaagttggcgggataggtttccgtttagggaatacatccactttagggctccgacggccaacatccgagatgatctaggtaccccataaattgcaagtaattgcaagtaattgcacggaattgcaatagcttaatatattcggtaatcccctatattctgcccatgtcatcatggggttcttagttgccgcttagaccccgattaaggctcctcaaattacccgaagtgtctcctgcagaactatcccaagtctctaactgcacgtactccgtacaatatacagagtgtacatgtaggatgacgcctattccagcctattccagccttactattggcccccgcttattacaccttctccctgaaatccgttcgatcctagtctgatcatccactgcagctactgtattcgatacggaacctccaccctagtcttcttttaagtttctgaacagttctttgtgatctcgtcaggttttacggagaaccgtatgtatctactccgtacaacattctaaaagtcgtgccaagcgcgctaacataggtatgtactccatatggatgagtgggcctggcatcattactcgacacagtataacctccgtatgcctcggcctaatcccaacctcactgcccaggcaagaccttccctctcctcacaaactccgccatctcccccgccgttccacccatcctctccaacccctcaacaacaccaacccgatcattcaccggccgttcctggctaaccttaaagcggccctcgatccgcgtgatttcaaccctcatcccaacaatattcttcaaaagcacagcaatatactctggtggcgcatcgctgattttccaagccggtctcggtctcggggtaggtagtgccgagccgtcatcatacccgctagctccggtcgccctcttcgccccctgactcaggcctcgatctgggctccagttcttgttctgagtttggggtggatccccatccccattctcaattccacttccatctcccctgtgtttgacatcagatcccggacccaacccagactcatcttgaaagcccattactccttcctctccaagccgggctaaatcacccagctgttgtcgtagaaacagctccgtttgctcatctttcgtgtcatggtatatagtcgcccgaccgtagacctgcaccgcggcgtaattccacgtcggagcaacccttcccgtggcgggtttggactctgtgtagaagtttggggtgatgtagtggtctactgggctggtgaagacaattaagacctcaccggggagagtgtggcctgttgatgtcgctggttcttcttcagaacttgttacgggaaatgcgcccgggatactggttgttttggtgctgtactctgaagcagattctaccattgctttgctttgcgggttttggcgcgcgatgtggccgcggaggactcccatggggggttgtggcggtgcgggggtgctgtcatcggctacttttgcttcctttgcgaactcgggttcgaaggccgtttcactgtccaacacccaggggatgtggctacattggagggtcgggtgattctccgaagggagagaagtggtgaggacgcctagtgggtgttgtttgatgaaggcgtggagggttgggaggtctcggactgcatgatcaggacgtaggtgcatattcaatttgtatggattggatatgtattaaggctaggtagaccctgaagagaaacaatgccggggtaaccttgggaggaaccttggaaggaaccttggagatgaggggttgaccccggatttgtgataaagttccaaccttggaaggttccaaggttatatattccatggattccatggatggattatcaatctatgactccaaacattaagatggcacaagggcagcaacggaccaattaccacctaccacctgctaggacatcagaaatactcaagtgcagctacacaaaaaatatccataggcacaataaataaagcgccattccttatacttaaactgccccaaacccctaaaacaaaattgcgacccaacatcagcatcaaaatctattgcatcaacaatagacaataaaaagcgaatgcgaaccacaaattacctacgtaggtatgcagtgtactatatgtactatataactagaaaagaggcctcccagacgccatgcgcacaaagtcaaacggcacattctgcccaacaagcaacctcagcgtctcaacagtagtccaagcactaacatcctcaacgccatatgctgtccatccagcacgagtggccacggccaaaggatcccccttcctcggcccactcgtaagatcaagataaaccctcccacgagtacaaggcggcgagcaacgaccattaacaccataatgtctcagcaaaggctgcacgagcagcgatttctccggcggcaatgcagagacaataacgaagggttgctcaacccgtttgacagactggatggatgtgaacggctcaagacccgcagcgagcgggccactcgctttgaacccgactgtgtagatcgtgccaacggccagactgcgtagtgcgaagatcgccgctgaagcgtctgcttgggagctggccaggatgatcgctgcacggctgctatacgcggatggaacgtattcgcgcgtcagggttgcgcggatgcccttccaggcggcgttttcgccgatgaatcgggatgttcctggtgcggcttcacccggtgtcatggcgattgtgtcgactaacccgattgcgcgggccgcgtcgctggctgcggggatgaaactagttgtggttggaactggggggttgaggtaggcaccaccgaagtgcggttggacgaggacggattccatggagccttttgggccgcggtcgaccgaggtgaagttgtgcgggaggccaagttcatttaagcatttctccatgaacattgagtgtggggttgagcggaacgagccaatggcgtagagctcgcgtttggggagttggcccattatgtgtagggcttcgttgatctccgccgcggttagctggcctggggcggcgatcattgggaggagggggtgggtgattggagagaagacggtgttaagagctcgagatagctggcccatttggcccatgttgacagctgacagaggtgggcctgcgccgcgggttttgatggtagagcggaagtattctagttcgtagttctcctcgatggtgtggaccatggcgatcatcttcacgatgtcggcgtatttggcgctttccgtgaatatgcgctgcgcctcttcggacgtccacttccacgtcccggagaagtcatggaacgcagataaaatcatactatggccctttttctcaaacagctggcgccggatctcctcgggcagccacagttcgacatcgacatactcaactccccactgtatcgcgcgccgcaggtacttgtaaaacagcgctgggtcatccatcgggaacttcccattctcccttgtacaacggacagtaaagataatcggcaactcagtatgctgccgcaacaacatcaactgctgaccaacatacttcaaactcggaacaggcggagttgtccaacccttcggcacaggctcaaccagcaaatccacacggatctcaacggcgtcagatcccacagaaaggatatctaaattcggcaaagcagcatgtacatcaggaaaagtagtcgaaatgaaattcgtcctggtcttcgttcgcaaatcatcatgcggcctcgtctgaccaaaaatcaaagacaaaaaccgcgacagatcccgacgcaggaacggactccgcgaatataagaattcatagtcacaactctcggtgagcgagtcgtctggcgtaaacccgttttycacacagtacgtgtttaccagaaccagagatgatcgctcgcatccttccaagctccgcgctaggtcgtgcgctagtatccccactaccgctgcatagttggctcgcgcaagcatcccaagcgacgcgtccgttgtccatggcttacccagaacctccgctaccagtcgtacaatatgctcttggtcctgaccgtagatgatcacgacagtccccgcggcagtggcggcggccggcgcggcgatgcccgcggctgtctggtctgtgggcccgctagctggaggagcgagagagagggttgttgtagcattggaagggccggcgatattggggtttgtaccaggaggatcttgggcttttagggcggtggagacagggggatcgtcgagcagcggcgtggccatgtgctgcggaaaggctgtcggaatcatggcatagcagtcccaagtgttttcatacttagttctcgcgaggatttatatgcaggtcgaggtatgggttaggacgggtaaagatgggagttggagaaggggggaatgagcgcaaggaccaaggagagttttttcaattcgcttcttgacgctcaggacccgggggtagcgtgccaggtaggtagtatcagagcatgggatattttacaaagcgcaatcagggaaaaagggagcgggccgaacaaggctagctccaagatatggggtatggaagaactcgtcgcggagattccacccaatgcccgccgatggaatcccacgcagacggcggacgcggggaaaagtgggcgcggagttgggtttctccaccaatcagctgccgcgaacgcagaattatactacatatggatttgttagtagggatcctactcagtagaaaggtgatatgtgatattacagtaatgatatgcttataaatcctatcaattaccagtggacatctacaaatgcatgtgttaatatcggccttcatgaaaccaccatcccagctggagggaccggcattaggctctgccatgatccgatacgagggaaagcccaccaatctaagccggcgtctctgactcggccggagcgaatgatcggctttggaacagattttacatagcctgttgtaccttaggtacccggggggggataggtaagcaacgatttagacgctaggattggtggaagagcacatggatacttgcgcaaggggcaaaggcgaagattagatggtcccatattaacaacgtacatagtaaaacgaccatctattcattgttatttctgtcctcgacgctggcaaagcaaccggaatcatgtgacagctctaatcggacctgggaggaaaattataccggagatatgtagtcgtgaatcacgaagcataggtacaggtgatcatttgacaccgcaaacatgtgagatatggaaaaaagaacgacagaatcgcgactagatccgcccagcatcatattccagacaaccaattaagacataaggagagaaaaataccagccaaatcaagagggggtattgggtagtaacaaggctctgaaggaaaacaagaaacgcaggccgagagataagacaggggggaaagggcaggaaaagcaaagaggcattggtccagagaagaaacatgtatgtatgtatcaatatcaggcacacaaataatcatcatatcgcttggaaaaccgagatagcgcttttaggggattttgttcatggctccgtgcatcgagccggagccaacactatgtacgaggacagcaatacaaccgatgatcggcgcatggactgtccgacatctttcaagacgtcgcgtgcctaccacgacagagcatggtaggtcgagtaagggagataagttcaagcgggagagaggccaaaggtgtacaaccacacatgcagcgttccatttgtgggatgatatcgggaagcgagagttgagccgagccagcagcctgtaattctcagcttggatggacacacatgcccaaactaaaacacgcagcaggcaatatgcaatcccattggctcgtcgttggataaagcatggaatgggcaacgccatggacaggggaaatcgggacccgagtcggagttggaaaggagtttcatgtttcaggctcgcgcagagaaacagaaggaagtgtttcgaaaaggtggacatggcacattgcccgcgcacacaggacccacctgcaaaagggcaggggatatcgagaaatgatgtatgggtcactcgcgggtggaatcgcaccaattaactcggcggagagatggcgagcccgttcatcattttgggcagcggctttctgcgagcagtatttgccgtcttggagacccgtggtgcaccatggatcatgcggggttctgtcatcaggctggtatctaggtgtgccggtgctacggtgaaattgtcagtgagcggattggattgagggtgagagctttcgagtgtacctcttgtcggaagtctaccgtaatcagctgaaagattctgctggctgcggctgttaggggcaaagaaggtagcgttggctgtgcgccacagatggttcgaggtgtctgagaggaagtctgttgtcgatcgtccggagaaaatggacgtgcggccgcggttgcgctttgaaaggacaatctcgtcgaacagggtcatgcgcgggtccttggacttcggatttgttcgctcacggtcactgatgaactcattgaagcctagtattgcgtcagtatttactccgcaatgcaatacgggagttcgccaacttaccctgtgtctgctgcagaattgcaatatactcggcgtgctcacttggaaggctcttcatgaaagcctccacgttgaaattgtaatgcatgccggacttcttcttatcaccactggctggcaggaggaacttcttgtacgtgtagaacaagctagcaaagcatctgacaaacgccgcacgaatttgatccggatggaacgctgcatcacacggcagacacaccatagaggtgcagcgactgtggactatcagtttgcatgcagagcacttgtacatgttttcctctgcctgttcatcacatatggcacaggtcaacttgtcatcccagggttggacttggaaatagtgaccctcggcccagcaagtatcgtcgttattgccgacgggctggtacgtggattgagggacaattgtggacgcagcgatggtagactgtgcatacacagacggtgcatatgtggatccgccaccgtagtcagtgttgagagttgtcactgaaagattcgaagcatgacccaggaacggagcacttggacgtcgactcattccaaaggacgagcttcgacgcgaggcggcatcgaaatgaccggaacgcttctcgcgcaaggaagcttgcaatgccataccggagtcattgcgagagggggctagtggaggagggaagaaaccagaagtaggcgagctctctctcggggatggcggagaggcactagctctcatagtggagctggtcccgggacgctcattaccgcgagatgagtacccacgagaggagccgccctcgtttcgggcgtgcaggaagacgttgaagatcgggggtgtataggagcctggcatcacggctgttgcaccgaatgcgctagagttcagaccgacatatttcgcgagattagttgcaggcgctttggatgtgaaactggccttgctctccgacatgaatgagtcccatgggtacgtctcgatggcatatgcgggaggcccggtggggacgtggcatcgactgtgttgaggggcagctagctgcagcaaggagaggagcttcctgcgctgatgacgtgggagagaggtcggttgaatggtgctttcgatcatattgttgtctaaatcaaccaggacaaagtcgtccgtgggcagctccaccttctcataccgacgctcgatacccacgatgtatgggcaaggggcctcgagagcctgaattaagcgcgcggggaggacaggaatgagaacgcctgtccattccagagggaacaaaagatcgaccaacgctctggtggcgagatagagcatggaggtgtgggaagacaagaagatgatacgggattcagtaagagcgtactgcgtgttgttagcattgtctctagtcaacttacatggcaggttaagcttacctcaaagagaatgataatgttgggaactgacaaagtccggaataaggcatagagatcagtctggaaatcagtcagcaaaagtctggagaactcaatcaagattgcggtgcacatacattccgagaaccagggatctcattgggcgcctctttgcgtgcgaacaagcgcaactcacgaatcgcaatctcaacctgagtcttcgaggatattgggcagaaggcttccgtgcagagattcatgacatatcgctccaacggctgccatatacccatacgcggcgagggcggaggcacgtgctgtacactgccctccgtcatgggcaccaccacggccttgagccattccttccagaagctcgtcatcgtgctctctcggcccaagataccgtacgcacggggaatccagaacccagtgtccccatcggtcaaaccttcgatcttggaggctgcgccgtgccggactggacggaggagatcagtcattagcccaatcttctcctccacggcgctgatatcatcttcgagctgttcgcgggattcagatcctgacgggacagtcggcagctgagctaggagccgggataatttggcccgctctgatgccaaccgttcgcctaggcttgcagccagttcacgctcttcgtctgtcatgttgtcctttcgccattcctcgcagcgcttctcgagctcttccgccgcatttgggttgaggggtatccagatgagcacacagatggcgtgcagcctagatccattgtccgttgtcatggcgaatccgtgccaggtagagcgcggtcgctggtcagaggagacgatgttgacatcattcggaaaggcaaacatagggacatagtcggggaaattgccgcgctgcttcatctcgtccggcatgccgcgcgtggggtatcggtcgaggagaacgggctcgaatcgccgtttcaacggatgcattgtgggggatatttcgaggggttgaggaaccgggattaccgagttgtagttgctgagtcgccgagaagttcgcaccgaagctgaagacagttcattgtcagccagtgcatctagagaaagttccggccacaaacccgttccagagtggctagaaagtaaagtcaaagaacagttctcaccttgacgagcgattgacggctgtcgtttcatactattcatatcccgaaaggatcgtcgcacgctcccaatacccgacctcagcaagttaccgccaggcgaaggcgaatcgtcggagacgatcttctgcgtacgaaccctagatcgcgggcgggtattcggggtaatagcgccagcgctcaagcttaagtcggttaggaaggattcccgctcgttggcgaacttgaacagcgcagagtcgaaatcgaagtcctcagagaacagagccgaggcacgcaggggcgaagaggcacccttgacggtcatgctgctccggttactattactgccagccccatttgttccctctgaggttttggagagcgtggataatcgttgggcagagcccctgtggctagggccggtgaatagcatggagtttggccgggagaccccatccgggttgtgttcctcctccgcatcggcatcctcctgaattgtgtcggcgagcgcagggcctggtgatgcggcaccgttggcacggtaatcttctcccaatctctggaaggtgtccaggatctcagtaccatccacgccggctatccagaagtaatcggcgagaggggcgccttcggaggtgcttgacgatggcattgtggagagagtcgcgggggactgtagcgggttaatgccttggttgtcaccacatggaccgcagtatttccaggaaagggaatgcgcagtggaattgagcgcatgtagttttcgggagggggatgataaaaatgggggagaacgggagggaggggcagttcagagcgaagatcaattttggggggtttgaaggtcaaacgtattaaaaaaggagttcctggtttatctttttatttgtgtattctacgtaatcattttctacccaaatattttccctttgacagtatttctgtctttatttttaaagggaaaaaaaaaagaaaagaaaagaaaagaaaagaaaaacctttcctttccttatattttcttttcccccctagaatcacgggtggttgcgtacgctaataatgttactagaactcgaggacatttaaatgtgtgcacatctctactccactatataaaaatggtaagagttgcccgtgtcaagtccaaacgtcttaacaaatcaagccagtcaagggcccgggccattcacagccctagcatctatgcacaagagtcttgacaccgtagcctgcaggtatgtgcattgggtgggctagactctaaagggaatccagactccagacttccggggtatacccataatacaggttcattacatatgtatacatctatcaactgggtgctattctcctattgcttgttaccgtatatagacaatctctagtaaccttggaataatgttaagaaatcaggaaatatcaaggggttatcccgtagaggcccgtgatccatggttgagcttctgatgcaagcgggtcttggctgatccttttcttaacgaggttcgtcaactaactagtacggagtacggagtaacgagtaacggggttggggttgattgtttattttcagttgagacatggcgttcacgtctttctatttacgggactttaggggttcttcggcacgccacaatgtcattcttttttatatctgacttttaagaactatcgacaactttcagggggtaagactatcgggaactgccgacgtcgggttgtaaccctttttacagtttagttcagtttagttcctcgtgggaaccttgctttttagattgtgtctgcttcaacggcctttttctttccatcgcagcaatgtacaatccctccgtaccctttcttctgatcctacaacatacaacatacatgggagtgatttttcgtgcatgacacactagtctatgtactttggtacataggatttgaagccaggagtcaccaagtggggtggcttgtcccggggagatgatcaatactacagttggacaatgtggagcaccgaggggtgaaagcatcgcttaagtgtatcaatttccacagtatccatttcataaaataaccttgcaaaaataaaaagtaatctggtaatctgatagtctacgtagataaatcccacagttcgttccagtgtcaggattcccctggatccgccaaggctctcgtacatgtatgtatggaggtactcctccgtatatctctaatatgtagctatttgggtaccatcctggacaagtaaacatacacgtggaactccaaagttccaatatacttactccatacggagtatagtgtatcgaaatacaattctatttaatgccctagacacgcctaatacccgcgttacgtggcacagggcctcccctgcaccgatagcccttttcgactggtcgcatcccaggattttgggcaaggttattcgggccatctccccgtcgatgtacattcgtactcacatacagtcaatgcagtcaacagtgtgtacgacttgacaagagaagaggcggtggagcagatcggcagacagtacggagtagcctaaacttcgtatattcaccaaaaacaaaaaaaaagaagaagaaaaccaatagataaaagaccgggagtaaaactaaaatagaagcctgtgcgagacatagattgcggataatgatctttcgagatcgggcatgtgaacaggctgaaccccattgatcagccagccctggagccctggagagtctagactcttccaaatctggctaagagattttacatgtatacatacccgaaatattgttttatgtgatatcccgtagaatacggggccttggcccgaggacgaattgtcgtttctatttattgacatatttatcttgtgcgagacctatagacaaggagtagtgaaatgcgcggtcaaagggtgcaaatgtccagcccggagcttccttgccgagagagaactgccgtgtgacaaaattaagcgttggctgcatggcaaggctggtttccgctccgtgctagtggcgccagcccagccaatgcatcggactctattctagagcctcaggcagtcatttgtcggacctacatagattgtgtggacatattcagaagcccatattacacgatacaatcccccaatttaggacgctgctgccaatgccaatggtgatattgtgtaagtgggacattggaaatgcgtacaaaccgcccttgcggcgccctccatgcaaccaggcggctggatgcactaatacaattcggcgcccatattgtgctacaggggcggaaacgatccggtgggttcgttgcacaccgcgtttcaggtgcgtttccggctcatcaggtttcccgtggtcaggaaccccttgtcccccatagcaccgcgccattcaattgacaactgacccagcgtggcacgaccgtcccgtcgcaggtccttctggagagcttcaagtccctcgttctggccctcttcttgttccaccaaaaacgccacctgtaggacatcccgtggattgagtgtaggtagcgcccgggttgacatgtctgtgttcatcatgtcccaatttagagattttgattggaacggtggcttaggatttagtttcgtttgctgtccatcccccgatgttagccaaatttttgagcattccgacccaggccgggtttcagacacagccgcgcttcgttgtgaaaaatccaccgattcgctaggaattaatagaaaattcataccttgactaccacggcgccttcgcccacgttttccagttgtgcctctagggcaaagcggagtaacctcgttttcccgtacggaccgagtgacttattatctacctcgagcggcggaagttcggacgccttggtccgcacgctcagacagggctgtgccacaaactggtataacttgcggaaagtcctgacccggccactagctgcctgcgaatctgagccgatctttgtctccgtatagctgacactgacagctagtatgtggtttccttcttccttcaaatcaaaccgcacgatcttttgtaatgactcgccgatcttgaggccatccgttgatgcggagtcgctgggtggctccagctccagtgccgcaactgaggaaggtgtttgcatttccgctactatacgcacggacgtgaggagtctgtcatcatcatcaacattgatttcattgttcgcgctgagtgtgcatccgaaggtctctccgacgtagactgatccgaaggagggaggtagagtaagctattgccattagtgaacagtttccttgaggtgggtagtcactgtctcacaagaggcgttaaaatgaattgatcatcagaatcactagacggatagcttagtgaggctttcgtggatattttggttttagacgtcgggagaggatgttgataagaaagtgatggccgcgcaaggctgtgtatcgatagtcagaagctgccataaacgggacgtatatgaatcattcgaattaccgcaacactaatccgttcatgattagctcgctagtccaactactggttgagttgtattcccatacctttgagagagaccgcatgtggttccttcggggcatcagcccccgacagagcccgtgggcgtgccatggagaataagttccaatattagctccagagggggaaatggaggagtaaagaattagctgcaatgctgggagatgcagtatagcgtcatcttgtcgaagagggacagtccacttctccacgagctgatagcgatagggaagctgccccaaacaaacagtgcaaacacccgctctttcccaaagagtgtgcgactcatacagtcgtacattcaatctctttgtttctttgtctctttttctatatgtatgtactgcttctgactcgcatgatacattctcagagaattcagcatctactaaatgatgggaaaggagcttggagtatatagggctaagtacacacatttaccattgacaagccttgtacatgatataggtttcctacctacctaggtaggtaccctctacaaactcttgtattcactatcctactgtgatagactacagtggtcaaaacagattgaatcgtgacaagccatgcctaagcgaaagtgggaagcatgtaacaaacatgacctacctgctgagaacaaaggcctgttatatctttctaagtctccatgcaaagtcattaacacttcacgtgtttgccctctagatcgtgctttctgcaatacatatatagagcaacacatcctctttccatggtcctctaccttcctagaatcgtatcttctcgtactcttaggaagtacccatgtcccagagttactgtcagactacaagtaatgaaacgttcctcttctcctgatttgccatcaagccctgatattcttgaccccaaagccaaaccccccatggagcctgttagccctagtaacaagcttgttcctagagctgagaactcaatccaagttgcagagcgcactccgcccaatgccttccaaatactcatgtctggaaagcgcactctaccatggctagcctcaccccccgacgggttcttagcaagagtctcgcgcactcaaactcaagtgcaagtaaatattgacggctatggcatacttccactggctaattagcttccgtttagcatgtatatgattagacacaaggttggcggtacgcaggatattccgcaaatctcatttgaagttgttggatctactggcaatatctacaaaacggtcattggcaaggtccctacctgtgactgtccggatgtcaggtttcggaagacgcagtgcaagcacatctgctttggtaagtatcaacctagcccgggctccgaagatacatgcctaccccattctgcacagtgcaaataccagtctctgttctttgctaatgtgttgtaaagtgttatctgcgatggatgtccccgagcaactgatgtaccagcggtcatttttgccatccgtgagtcctcgtagaccctaacacaacatcactttgttatatatccctgacccaaacttgcatccataaggagctacgcgcaatgcttgctgtgttatccttgaaacggaacttggacaggactacccttgcttccgccggcgaaaggaagcctgtcgagggccagtgcccaatctgtttccatggttttgagacagaccagaaaactacctggtgtcagtcatgcggcagcaactttcatagggcttgctttaagaagtgggaggctgctatgcgcacgtcccacactgttgtcaattgtctccactggtaagtgatggcaacttgttcaagtcgtaataggaacttcgaactcaacagctctccgcatatagcaatgccccgtggcagactgatgaacatggtacgccccatctcaacagagaggtcattcagaccaagggtgatcataaccgaggcggatatgtgaacatgggcggcaagtagtccctggttgtcatggctcgatcagtatccttttgcccttagagagtctatcccacgtcttgacttctggttcccctactaacgattgcttcttgggatgacatgggcgactcgtcttcatatactactaatcctatcgctgtcaagtccaaaatactgaaatcaagacgcgacgaggatgagcgtgttcggcatgaaactggaggtatcatgtctgcggggacgtaacatcaaggaacggctctgttacggaaaggtctcttgttgtggtctctttttaccaattcgcctttgtctttggaaaattgtgttgggaagtttttgttccagaaatctatcattgagtgacgtaccctcctgccggtgcaagcccaagcaagcatggattacttcattgcaccgtctggaataaggggagtcaacttgtggtgctcttttatcaatagaatatcttatgcatgttgtggggtcaggaatgtagtattcggtgttagtatgggttgaactgttttatgctgaatgcactaaatgaatttgatactgttctttacaatcttcagtgtcgaacgtcgactacatctggttgctactacactcaatcgagatatctcacaagattcacttttactaggaaagccaaatatgacaaaagaaagtccattcatcccaactccgggtatcacatcaagccccaacggccaagaaacgcaaaaagaagcaagcttctcaactcaaaatccaataacaccaaacagattattctatatatccttttgaagccgtcggcccagtcgaacagtcgcgacactaacgccttcctcgccagtcatccacgacggcatacgctcagggtcaacgatgcctagctcagcaagtttgcgaatcccgccgatgacgtgggagccagagaaagtcagtgacaaggcaggtggcgtgaagatagaatcatcaacgtcatcatcatactgctcatcactagaacccggtttgtcgaggagccggatatcaagtcggtctagcggtgccggggcgagtgatgaccccaatgtgccaaatcgggagtggatggccagacggcgtttcttcgaatccggagaaaggggggctgtatcaataccgctggatcttcgtttggtcgccgggctatttgtgttttctttgccttctgttgggccggaatgactcgctcggatatgctcttcaggcgatactgtattagagggccgagggtccaatggacttccttcagtggctgcatctgcaaagatgctaaaggcgccattcgaggccgttgatcgtccggggccacggagagctaggagcgtgggcagattcttggctgccagggatgtcgcctgcagagagaatcgttcctgtgggcgggataaagctttggggatggaatcgcgcaccagacgctgaagggttcgagtatcagtagccacagagcttgtggaaggggcagattttgatccggtggatgttgctatggaagtgtagacgtaagggcaactgtccgggaaagcgacgtagatgactcgggacgagtcagtgaagatctcggctgcctgtctgggggactgatatggcgagtcaacaacaaagatacgcaggaatgtcagcggcagtgtagccgagtgggcgaggtggtagtgggccttgaccaatggggagatttctcgttggaggctttgcacaaatgttgccgattgcatgcgcggtacagaaccggaccagtcagtgggtggcagaccattaaagttcttgcgctttgtatcagtacggctaagctcgagtgcagtccatcgaaggctggcggggtggtcgtccatatagcggaggtctgccatggccagttggcgcagtgtaatcccatgccgccaatcgccttctaggattcgttcaataacctcgcgctttgcaccctttcgatcctgcagatcttcatacgcctgacggacttcttcaattgtcttccccgcagggtaagggagggcgtcgtcatcgtcggggccatcttcgtcggtctgcaagtatggtgggaatgaggcgacgttgcgatcatcaagccacgtaaatgctagatctagtagtgcttgtctggatagcttccccaaggattttgtaagagacggagttgatgagggaatgcggaggttatttggaagactggctgttgtcggggcgcgcaccgttttgggacgcgccatggccgtagttgacaaggtattgtggcaatacctagggaagttcaagatcaccttatatcaatggcaggtgcatgctctggatccatatcttgatctgttcccgagcttgtccaagttctgtccaaattccaaaatcgaccatcaacaaacatgcacgtgctgataagctgataagttccaaccttggaagagatcgaactgattatgtcatctgggagtcccgcccatggatccagcttgtgaagaactaagtgttgggaggtcacctgatcttggaaggcattaatcttatgcactttgaggttccgattcagcgaacacacagtgacctatcaaacgtgatatgtatatgtatatcaacaccctatgtataatatgcattattggatcgtgtatgaatgcgcaagggttttaagcagaccgaggcttgctgacaaaaatgtgggtcacaattgaccttctcgcaaagccatcgttgaaatgttgaaagttgtatgatgccgccaactttcgtttttaagcggacgttggattcttggactcaacgtcagaacttctttctcagtcccgggaaggatcatatacactttccttctcttgcgattgtgaatgaacctttccctccttcattatggaggcgaacgaaccacgcaaaaacgttgccgtaatcggcacagggatggctgggctagtggtcgcatacattctcaggaatgattctcggggcagatttgaggtggaagtattcgaaaaggtatagaagtataaaagattcacccgcgacatcatacatgcgaactaaaactaatcccaacaaaaacacacagcaagacaaactctcgctcgattccgcgtcatatgatctcacaaacgaaaaagacggaagcgcgaagcccgaacgtcttgatcttcccatgcgcacgtttgccgacggatactacgaaagtctcaagcgaatgtacgattatttcggcatcccatacggctcgctacggtttatttactccctgtcgtcactgccggacaatgccggaaaacaaccgtctccatactatatgcattcctcaaataaccaccaattacctcctttgcgtccggagggcttatcgtggactgggtggctgatcgaggtgtgctacctcgcaatatgctattattggttcaaagcctgctgcttcttcgtacctcccaaaacggtggagtcgtcgggtacggaagaatctctgcgtgaatatgtagagaggattatgttgcccagttactacgtgaaacactacttcctgccgatcttcgcgagtgttgcgacttgctcacatgatgcgctgatgaatttcccggctcttgatctggtcggttatgggagacgaaccttccgtaagaatcactacactgtccttggtggagttcaatatgtcgagaaaaagctgtccgaagacttgacgtataatcttggcgcgaaggtcacggcagttgagaatatcggtacaaaagttcaggtgagctggacagatacccatgatggccagagcaactcacggctatttgatcatgtcgttctggccgtgacgccaaatgtggttggcgcgattttccagcccctccaaagcgcaatgaacgcagttcccacaacgacagttcaatccgttgtgcaccgcgacttttcccgaatccaggattctagcaaatgcctctgggcacaagtatcattgaacgccggcgaaccagcacctcacccactccacatgtgctctaatgctacggcaactgagactgtccatgaacatccatcatctgctcttatcacgacgtatcctattgccccgatcgaccccgggaaggtcctgtatactgccaccttcactcgtgttttgcgatcgtccaccagcagacagatcgtcaacgaaattttcagtcagaagtctggagatgataagagccagctttggcggaacggagatggaaatgtctggcttgttggtggttggtgctgggacgggatggtactactagaagggtgtctttcttccgcgaccagggtggcaaaggcccttgacgtcgaggttccttggatgaaaaattcctctttataacggcctgtcaaggacatatcgagactttcacgtacatattcagttcgggcatctacaaatgttaatacctggggacacattgtacatagtatatactatgaacaaacgcatcatgagcatctgggctttgcgatgatatactaatctggtacagtctatggtctgctggccatttattcagggcccatttctcgctgactctttccacctcgaactcaccagaagataagcctagaagcctatatacaccaaatgcgcgataatactactacatggaaatggacactgttttacctctgacagaacgccaaattgtgtgtttagcgcatcacttacgcatgtcgggtcacctcgatgattgggttatggcggccatgtatttaatggtctacagcatccaggcagaggaccgactattgcgtctttcatagcacgtgttactcgtttcaataccaaggacatagtgacttattcgagcctcaatctctatgctcgaacttggaaacatgagctatccatataaacccaattcgtcccggcaaataaagtaccgcaacgcaatctccttttaaatacacaagttcataaatatctacatatatctgactcccgtcctctagggatatgcctggtttcaaatgcccctgaaatcaagtcagaccctacctgttgcctattaaaaagtccgagcaagtcaagttcaacgttggatgaactagctttataagtaactaagcccaatgctttctaaactcaatatataataccagtatcagcttccttggtgagagttatgctaaggttgtctgatccccggctgaaacgttagttttctctttccccgtttctagtaggacactacttgacatggagcctgaattggaattggaattggaattggaattttattgattcacaaaagaagatccgtgtacatttgaacgcgagtaatactttgcagtagctgcgagcaatcataagctttcctcacgagtcgaaaaatcattcaacgagtagtgtatccaccgttggcgaagatggtttgaccagtaatccaagcaccatcggtgcaaaggaagcgaatgataggagcaatgtccttgaccatggtgagacggttgcccatgccatttgctttgtggaattccacggcttcgggagattcctggggatagaagaaagctgttgataacatatcatgttagatccctagaacgagcaatgtatccctttattattcatgtcgacttacgtgtatccatcggtccaggggcgacattgttcacactgatgctgcgagattggagctccttgcaaacacccctacgatattgttagctcatgacttcgaccgatagtgcactggcaacataccgagtaaagtgctctacgggagctttgctaccagcgtaagaagtatagtagccagtaaaggctcctaggagcgcagtgacaatagtgatgatctttccgccatcagtcacatgagcagcagcttccttgagaacgaaaaatgcagtcttggagttcacgctagagacgtagttagccaaacactcttagcgagtttgcaatgcccttccccaacacaatacttacgcgaacatcgtgtcatattcttcctcgctaatctctgtaatgggcttcttcagcactctgccgacggtgttgaccacaatatcaacatggccaaaatcacgaataacatccttgaacagcttagttactgcagcagcagaggtcagatcgccctggtagaaggagactttgatcgaagggttcttttccttaagggaggctactagcgaggctccctccttttcgccgccggatgaatgatagtggagagcaagattggcgccctcgccagcgagctcgagggcactttgagcaccaaggttcttaacaccgccggtgataagggcgactttaccagaaagagacatttcgaaattgtaggtaataacaacggaggtttgtgataattgagtgatagaactgcaatttttggtcgagagatgtccgtcacttatatatttaggagtacgcaattgagcctattgtaatgtgagcgtagtatacagaatgccctacctagatgctgcattataaggcgttatccgcaaccggaaagatatggggcgtagccacaaatactttatttcattggcggtaatatgtgggtcagatttccccaaggttggatgtgatatcccgtttaggaagtcacatcaagaagctctatgaacctcattatacgcgatttcatgtcgtcatacgggtgtttgattctttttgattggttttcaagtagaagatttacattgtccatcaggagctacccaggaattgaccaggattaggatctggtataagttcatccccaaaggtcgtcgctgatccatgcaagaaagcggaattgcggtcaatccaaatcaccatccgatagagcaagccattcagccccagtgttgtgagcccccctcgtaaaccaatcactcgtacgagaccttgcatatggatactgtagttctcaagactgccgtacatggcttcatagcttgccatctttgctatagccattatcaaagcatcatttacagtccctgggtgctgagcctcaagacagcgattgatggacaggatagcttcacagcgaagaccaagaaggtccattttcatactgctaggatggctttgtagggaggcataatgcgatgcagcaagcagaatagtgacggagaacaaagcgggctcggtcatcactaatggaaaccaactggtcctcaggagaccggggttcccaggctggtcaagctcggggatatcaactgccatattcatcaagtcttacgatgttaatgaaagtccagtttttgctaaaccaaatccaaaaagtatatagacttacagtgatcgaccagtagtggagtccaaggctggtccgatataggataagacttgaaggggtccaccctaagtccgccaatttgaggcggtatcgaggctggtgccgaggtgaaagagtcgaacccggggcgggtttgaacttcagtggctttcacatcttgtgcaacatccagctgcgccgcacccagcaggagcctagtccggagtcgcttatctcgacgtgcttgcttccattgataacgcgtcacgtgagaccggaactcgggctccttggcgagctgaagggcgtcccctggtttctgtacgttgacgaagacaaaatccatccccatgatcctatgtgtggttattattcgacttgggcggcatctccagccgtcgctgacagatctcgggatgtcaagagactgacaagaggtgagggataaaactcgcccacggatttagcggatttacggattttccgttgcggcgaaaagtggcctagctgagccccctttagcccgatcatttgtttttttgtgcggtagcaaaagattatgttactgttttatcattctcgctaaatctatttgcattttcctgatgggaatatgattatgtataagaacaagcagttatctgttcattgccggtgaacagtcccctccgcctgttcttcggcttcctcagccgcatgcccttcctggacagcttcataaaatggcgcgaacttgctcttcatcctcaatcgcttaccgaagaagtaaaatccaatgggaattggaacgaggacagctgcgacgcatccgagaagcgtagaagcccactggatacccatgccttggaacatctggcgtgagaaaagcgggaagctggctgccaccatcgagcggcagaaggtgtttgctgcaatggctgatgcggcgctatagatagtatgttagatgatcccatgaacaaatggaggaatggcgcgcgagtatgacatacaacataagatacgtgtcaatcagataattgaacaattgaatgaagataatcagaagaccaaatccagtaaataggccactcagggtaggcacgatccagtggatggtaccgttgaagccagtccatccaaaccagaagagaccggcagcgaagagagcaccaccagccatcactggcgggagacgccactcggggatagggacaccaccgttcatgtcgagtttcttattatagcccttgctggcgatgatgatataagtcgcggcgatgaacaggcccaccaccatgccgaagaggggaagtcctccaacaccagcgttcataccgtaaacgccctggaagaccagagtgtaggccgttaagaagcagtagagcaacccgtagataaaacttaggtagacagtgacggcgaggatcaatggctcgttaattagcagtcgaagcggacgagagaagttgtttacgatcaggtctcgaaggtcgacttcaatctcctcctgcttcgcatgtattccccaattcttagtgcgacgacgtagctccgaagccttatccacaaggaccacaggtgggtacgactcctttagaaagacaacattcaggaggaaagcggcgaagcccatgaacgctgggatataggcggtccagcgccacccgagataggacatgttaatgaagcctccgatgaaaggtgctaggagagggcctaggaacacggtcgaggagaacatggcaatagcaacaccacgggtgcggttgtcccagatatcagagaacacagcagccacaactgccaagggacaactgccgaaaataccacagaagaatcggcaaatcatgagcgtttgcaagtctttcgcgactgccactgcgatgttgaagacgccaaatccgaacatggcgacgatgatagggagacgacgacccttgagttcggataggggagcccatatcaagggacctgatgcgtacccgatgatgtatagagagctggagaggacggcgacttcaaggccgacgctgaagtaactcgagacattattggatgaagcactaaaaacggcggaatcgaaggtggagcaaatactggtgaaggcgaggatagcactaatgtagcatctagtttgagaagtcagtatcggagtatcaatgctgcacattaaatgcccagtacggtacggaaaattcatggtgagacgacttactttcttttcaagggccagttcagcgggtataatgggtcatttggcccatcgaactccacaacgtaatcttcccgttcaggaagaggtggagggtatggtttgcccccaccaaaggctggcaatggagcccgtgacggtcgcgactgaagactctcacccacggtgagcgcatgttgagcgcgttgcgtctcggtcctgctcaatgctcgcgatgtcccagtccgatggcgttccaagtccagttctgtgtttcgcgattgtagcctatgcacctgggggtcatattcagagatactcgagccggtcgatgatccgatagaggctgaagtagtacgtctctctatctcagccgagttccgtggcttctcgctcggtatatgcgattcttcggtctcaggcagttgatcggccatattgccaagggagaccgctttaccgattcggggattatgatctggccgatcttgtagatcttcttggctgcagtctctcttttcccccgttgggactgtcagaaagatcagagaggtacctgtgcctgaaatatagaagggtagaggattttttttgccatccaaacgcggacaatttgtttataaaaacttgaacagaaaaaaaaggagcgccgaaagcaactatgatcgtctagacccaccacttagcggcttcagcgttggataactgccgaattgtcggataaaacggaagctggcctcagcacccgtggacttcctgaccaattagtaattaggatattatatccatgtatgtagttatatagattttaatttatattgccaatatcaatgaacaagttgcctggaggtgccaccgcctcttgacgtcatcatgaaacagcccacgagctacctacctaaagtacctctaactagttagttataccttagatacctataggtaggcttccacaaggctacatgtggcttgattacatgaggcttgattgtgctgagaaaagcttcacctacctagtaagtctattaagctgtacaccaggcctgaaagctatccacgagatttctttacgggtgcctcgatctatctacatcggaaaggtatgacgcactgatttgaatttactgatctattggtaatgcaatctcggagaaatagaagatacctaggtagctatcgaagtattcttttcatcttggtagaagattcaaatggaaggatcaatgaacgagaagctcccgacgctttcctctttctttagttattggagtactatcgcaatggattggtttggtcggtttttatagctgccatacaccacgccttgctaaaaatggccgaaaataccaccttttgacatataaccacatgcgacagctagagactggaccatccaaaccattaagccttcctcgcaacaacaacaacgcccctaacaaccctccccttagcccaccacccaaacacaaacctcgccgcacgaaacttccccatcttaatcccaaatggccttgcctcttcaatcctgcgctcaatgaagtctgccaacccaccaaaaacgtgctccgagatatctcggatctcaataaaagcaggattatacccagctgaaatgagtagctccacatattccttctcggaaacaaaattgccgaatggcgagttcgtgccccagcacacgagtcggaggaggatcctttcgtaccaagatatactatcagataatatcaagtcgaaggccatgaacgaggcattgagggtgttgtgtgcataggttaggagaggtaagcgggaggggcggaagtgatatatcgtgtccaaggccaggagccatgtagacgtgtcttcattctcattttgcttagttgacgcgactgcaagggccgtgactgatttcttcaactccccggtccaagagctggggactgcagcgtccgcgcagaagatatctgcctggatagggtcattgctgtctcgcttcatatgattaatgcggcgtgagccgagcgcggcctgcgctgactccagcgtgattccaatataggaatccaggtgtatcagagaggaggattgcagcttggtcttgctatgacgagaccgcaggccacactctgatgggtgaatatcagatgcgctagtggagatagagacaggggttgttgccgtggttccgatcccagccccttcagaatcggacggggatgtagaagaatggccatttaaaaccttcgtcaggtataacgactgatcaccacacccgcacccgacatctaggattctcacggcagacgccttctccgttgatagcgcagccgtgagaacctgctctaggagcgcttggcaggcttcggggaaatcatctgtgtactgtgatgtttgtcaatgtggatttcaaataagggacttttacatgagacaattgcctaaatgatctttatctgagttgacttacctcccagtaccccatgttcatccacatgctctgcggtgggagctgtatgttgaggacggcatgatctagaccatacacgtttgcgtgtggttttctcagggcacgtttgagggacccaaacatttcttaatagtccggggaatagaagcagacaatccgttctctttcctcgaattttggaaacctagtgtggagtctgctgggccaatcagctattaatgataagccgtgttggtccacggtgtacagtgacgtttcatgagtgcttgcaccccagtactgcggaaggcaccaggccacctttctgcctattaacacttcactcaacgcattaaactaatagtttaacagtaaatagaaagctcacatacacgcttatggatatatgttagaagctcccgctagcgggctataatagaagaaagtacaggaagagcaccaggtggaagtactggggtgcaaatactcatgaaacatgactgtatattgaagggatattgggcgatttcttgcaatggatagtctaggcgagttggacagacgtaaaactggaccgaaacacatgaataattgcatcaaaaatacttgtactgcgtgaagagacatcactcatccgcccaccaccccctggacctgcagacataatacccaatatagctctagctacctaaaaaaaaaaagagagagaataacatcgctggagaagaacactataaacaagaagacaaagatggtgaggtggagctaacagacaaaagcccaggacagtcaccacctgaagcagcagagcggagtaacagggcaatcaaataagactgggtggggtttctttctttctttcttttggcgacttttttctttttctttagtattgggcaattacttcatacagtggtgcccacaccgcgcttcaggtcagaagtacttgaaccatcagccttctgtgaggccaagaacttcttgaacatatccgagatgtcttgctcagactgctcgtcggctccgttcttctccatgatcagaccacggagccagtggttctccagctcgagctgagacacgcgagcctcgagaatatcgttcttttcggtggtctccttcacagtctgctcgagagcagcctcacgctgcttcttcttcacacggaagcgagcactggcggcggtgttacgacggcgcttgtcctcctcggccatttggcgactagcctcctcgacgctggccgcatttgcggagctcttgcgtttagtgccggtaaccggagtggaaggcgacaccgacgcagatgacggggccggagcgacctttggcgcgttgttgataggcgcaggctggataggtgcctggtttgcagtcacaggcccactaggaacggacgaaaagtggggattgtgcatgggcacctggacgttggaggtcaggttgggctgataatcgggtatgccattaagaccatctgctggaaagccattagcattggttcaatttccaaacaacatgcacatcgcgagtttcggtttcccgaaagtagttggggtccgagcacaggtgccaatcacgtggaatggcgtaatagtggggagcattcacgtcaacgaccaaggtcaagtttgagtggaagaaaaccctgctagggccacgggaaggatgacatgcagggctcaaatttgctagccaaggaggtcaaagctgtgaaagggcgtgggatgatattgagcgcacgaagcgcacgaagcgccaaaaatgccaaacccagcccagatctgaggcgtgcaataggcaagaatgacgaattcataaggcaaccaatgaaacgacatgcaagatgtagacatcggtccaatcaacccaattgtgaataaggctggtgcgatcaggggaaagctgtgcagctcggacttgggactacccaaccagcgatggaaaagacacgaaccgataataatcacacttaccattcaggaaatccaagaacttcagatcctcattctgcgcggattgatctgggacgacctggtgtgtcttttcctcttctggcgagaatgaaggtaggccgctgaagtcggtaaacttgtcaaactcgaagaactcggtattggtgaacagagctaggtcctcatcgttgaacgtagtctgctgctgttgctgctgctgggcctggtcgtatggtgagggaatcgcgtttaagtcatcgaggtattgcgagaagttgggcatgcggcgcccattgtagttggccatgatgaaagttccccgttttccccggtacaatcagctgagggagaagccggaaaccgatcttcttgatgccgatggagtgtgtggaaatgcgcgttgcgcagaccggagagacgtgactcagatgccgaatgcggctcggtgcggattcgtcgcgagtgcgatggaagtcgaagcacctacgaggtgactatgtttcgcctcgtgtgaatggcggttttggagatgttgtaagttggatagaagtcggagcgaaggacagagaagttggagccacaagtgggttttttctttgaatgttcagtgggggtgggaggcccggggcgccggaggggtgatgattaatcccccaatttgccttcatttgcctcctaatccggacatcctgtttctgttggggatatatcctatacttataataaattccctttctcttccaatttacctctcccttttattccttcccacgctctatgtaaatctaatatacaacattgcataggtatagaaacgaatcgatcgaaggccgagaatcggagcccactgagtttaaatcctcggttccacgttccatttttggatagaaaatcccacgatgatcctacatctagtactccgtactaacattgtatgagatgggatgaacagtgcataaattgcgaatcgcaaattgctctactactactccgtacatttcctcattttcctagccagagtacattcaataacccagcgacaaacgcggctctctcacaaaaccaacccgaaacggccccgaaatcggggtctgccaccgctgattggcggacttgaccagcttggtcagcatcgaactcaatggaggaacaagttattctgcggattttccgaggtcgctccgaattattaatcaacaaacctcacctgggcattcgaatccgatatcttgactattatggaagatcatttcaacgtcaaacaaacatattaagacggtacggtacatgagggcccttgataatccttaagcacagacttttacaagggttgttcaaattcagatgccggatgactcgatgagattagcttttcttatttcggtgcactggcactggccagtggcggctctgcgtataaggaataaaaaccgagtcgtcaatctcttggcttattaggaatcaccaattcgatccggtaatgagcactctactttcaatgatgaatgcaagtgcatagcatgtggactgattttcctactatccccgcactcatatacatagtagcggataatagctcttgagggctttgcccttcgattttagtacctagtcctggcttttccatcaaatgtttgctcactaagttatgaactgagcgtacctagatatgatcgacctgagtaagctaaatcaataaccttggaaactgcagcacgccagctttattccgtgcacctctaacccaccatcgttccatcgaagggatttggaacatcagcttaagtgtccatcctcacagtctcttttctatggaagcgaaggacttgcggtgcggttattcaatttacgctcctaggaatatccctaaattggatttggacgactagggcgaggacaattaggtggatctctatgggatctgagccctgccctataaagtcaactggagagatctatgttcagcgagtaatgactatatattacttctcccgtcgacgagcacatacgctaaaggctttcgtgggcatatttctaccaaaaataatgccgctgtaaatagttatatatataaccgctgtccccaaaaatggtcgatctatagttttcgctcatagacatcttaatctaacacattttcggcttctaatatggatgtgagcgaccttcgtaaactccttcgtacataccaacaataatactctaggttgccattaacttagctcaaaacgctaaaagtcagcatttcaagttcatcaatgaagccgcaaaccttcccggagaaggtctgcttccctagaaacccttaaaagctaccaaaagtacaactatggcggtaatgtgactataccatcgattatcttttatcaatactacgggggaaggtctagtaagcgtagtacatgtcatatgagatccaagcgcaggccgtatgtcgagatgttccggaaggacctctattcaaagctcgttagccacgaagtggacaagagaacaaaacagtgaggattgttgaattctagctataggtccccatgaaagctctcaaattacctggcacagcagaattaatttcataggtggagatttgcggctccagagaataataataaaaggaagcgttcaggtctaattgcgcaccgtcttcggaaattactagtaaaatcaacctagaaaagctacttgttatatctttctaaacggcctacatcctaattttatctgttctcaaccatttcgagtagaaacagattaatttgagattgatacacatacttcttcgacgctgaagtggcgaatgggtgttttcctacggtagcaacgatattttggacccgggtgtgcaagtacagtgtcgataaaagctcacctgcgtccactgcctccaagcccctagctcttaatagaactcgacccaccagcccaacggatattaagcgttttgctgtcggtattcgaatctcatgcccaagacatcttaggtcggtgttggctagagttgaagctacaggttcagtaaccagtatcatactagtagactgtcggtcagtgattgtatgcgtttagtgaccagctgtcctagtgtacacaagtagcggtctagtataggtcagccacgatacctgtacgccgggtaatgtttgggatactacaagcaaataagacaaatgcatttccctaatatagcatgatcgtatacagagtagtgctcctgctattgcaggttttcagaactataagtccttgtttgatacgtcttttattccgtatgttctatgatgatatcaagcatatcattagctcagttttcccggcctaactaagcgggcgttactttattgagatttacctactatagctctcttctagctactagactgggctcagcctactaccaaaacccgaactcaacgtgggttgggtgtgaagttcctatcttaggcacacttgcggttcatagcgatgtgtaagtacacgtcactgcccgggagctaatcgatacaagtaaatatcctgctagctgacatctaagccattgtcctccgcatttgtgcagttgctgattgctgatcgcgacggtgtcaaactcagctctcggcgccttgcttgcttgctacatccacgttctcgttgcgcctattgtctaatatcactacacgtcagcctaatgcactgcccaggtagcccggtttctctctggcctatcatgtttggggcattaatgcaaatttcatggtagtctaatccagtgcttcaaccgacttacggtcagtatcttgcgtagtttctaaataccgctccaagttgttgatcagtatcttgcaggttggcgagactaccgggattcgcttggaagacttctatatcctctaggcgtatattattttcaattttgagtgtcattgggcctttgctctctgtttcgcgtgcttgcataccctttcaagcagaaggctcaggagagtgacttgattcaactcgatctcgttttcattcacgtgccatagatttgcattctccttgtcccctttctcaagtttcttctatactcctactgcgctcctcctcactttctatgttgtatttgattttctctttcgtgtctttattttattgtgttgatatcccaatacttacgccgagcctctcttcttcttcttttttttatcaatttgttcccacttggtggcggtgagaatacttagatctcgattggcgtagtgaaagccacattatgcatttcctgcatgattttggcagatccagatccataatttctcgattaataataattgaaagatgatacgtaccacccacatatgatatactacaacggctagtagacgcacgttttagggtagataagtcctgttcactccaggtacgtactggcctgcgctattgaaccaagtgcacatctgtgacgtgttggggtcacactccaatcagacctgataatatagcgcccaggctgcatatatcaggatctagtataacattcatactacgccaagtctgtgagcgactcagttacatttctctactctatagtgatgcagtactttctgccgcactattgcaacaatgtggagacctaaagaatctcagactgctcccttgaggaatggatcgacttcttccatctcgacacgtaattttggtctcttttacaggcagccactgtagatggggtaatgtcgcagtgacattcacgacctgcattgcatagttgtacaggattgccggggacagacaccttacatcactgggtgtgattggcctattcagatccgtggatgaatatcaaggaacaatctggttgcagctttcactatacgaggatgtgcagtgacaacatcattaatgcgtaacggaggggcgctctttcgtctcaacacttccaagcattagccactgtatggtgtagcttgaattatataaaggaccccttccccccgttgaaccctttccctggaacacctgcaattgaagaaaattgagcctgtcatccaaaatggcacctcccaacaaggagaacatccagggagacatctggtaagttgataccctgctatctgtttcaatctgggaattcattctaatgatcccaggccccgtttgtccaagaagcatgagctgtttgtcttcttccgcatcactgaccctgtgaagttcaaagaccacctggctgtcctcgttccaagtctcacgactgccagtgatgctgagacgtttaggaaggacatttacaagaagaaggccgaaggtactctaaaaagtatcgtctttttctctgccatcaatgttgccttctccgccaagggtctagcaaaggtgggttataagactactcgataattacatgagccgcactaaacaatgctagcttggagcggagccattcaccgatgatgtcttcaacaacggccagtgggaggacctgacctacccccttgagggagatgaaaaggcaaagcataacggtctcgatgaccagcatgattggttccaccaattcaccccacgaaatggatatctcgacggtgttttcactatcaccggtgatactgaaaagaccttggttaataccgttagatcggttaagaaggctttcggagtcggtcttgagaaaggagacatcccatccactggaggtcataccatcgacacgccaagtgttcaatttgtctttcagcagcagggacatgttcttgatgatgacaaagaacagtaggatacttcacgctcattatacatattatatcagactaatccactgtttagctttggatgggttgatggtatctcccagccaattgtcattggtctggacaccgatgaaaaggtcgaagaagccaagaagggtttgaagccaattcaggctgggtaagctctaaacatcccacaccaagatgcctggaaatccagtcgctgatggcctcgctagtactattcttgttggaggtgaaggcgatcaaagcaatcacccggcttgggccaaagagggaagcttcatggtgttccgcacatatgaacaaagaacaccggagttcgttgcgtaagtgtaccctcttcgaatttgttctacgatactacgataatctaaccctttcagctggtgtgccgcgaacaccaagaaattgaaaaatccggggcaaaaggccgaagctatggtagatcttcgaaaattctcctcccgtattgttggaagatggcccaacggtaagattgcctcttggatgtgccttgacttgcagcattcacttacttgatatgtacaggagccccgcttgaactttacccagacgcagatcccacccctctgagggatcctgatccagaaacgaacaagaagttattgttcaaggaatggagtgaacagggtaaaaatcctcacgaggaatacaaaaaactggaagcgacgaatcacacggatgccttcacttacaaccctgaggaccaaactagatgtccttacgctgcccatatccggaagtgcgggcctcgagatgacttccccaattacgaaaggcatcttatgatgcgacgaggaatcccctacggaccagtgacagagaccaacgagaagggtgctggcgtgtcccagcatgatcgtggtctgttgttcgtttcctaccagagcgacatcaccaacggattcaggtttgtccagaaaggttcgtactcccccacaatgacaatacattcataattaacaacccacagaatgggcaaacaaggcggataagcctgtcgatttctctgacaagctgggaggcaaagccccgcagggtatcgacgctatcatcggtcaaatgcctccctactatcgcgcggagaatgacgttaccaaatatgacagcccagctcctaatgcgaacttccctgatgttgagaagcctgtgccgaagccgagcaaacactggattcctattgaacgctgggttatccctcgcggtggtgagtacttctttgctccttcaatttctggaatcagagagactctttgcaaataagcggggcccttgcttcattccacatacattcacccgatgatgatgtgctatgcgtctggactcgttcagttttagtcttttgctggtagatagtttgatgctctgtgcccttctcggtagcaaacatggctcgattacatcagtctcttatctctctaattgcctaaacttgatcttaccatggtgatactacaaatggatgtactgcatgaatatgtgggcaaatcccttgttcttgattcagatagaactaactctattcccaatgttgctccaatggaaatttacctgacgcaagtatcccagttctctcggttaaggcgagaccatgctgtatcctatggcattccactccataacaatagaactttatagtgttgtggtcgtggcaaatagcactgtgtggatagctgatatacgcatgcggttatgtgaagtactactgtcgaaccgtaggtatgatatgcgagttgcgatatgctacggcggtggtatcttctgaatcctttacactgcagttctaatgatccataattgggtgaaccaagggtgtagcaggacggatttgtgcggaacaatgcttagcgttttggatgacggaaatactcaagtgttgcccagccttcaaacgaaggaaaaaggttgtacggcacggaacggtccacaatggacggaatgggccagaggcgtccttgcagcattagatcgtcgtcataccgacatgctgtacaactcgagctgtggatctatgccttatgcatgcgtcttggcgcggccaatcaatcgaaagttatattgggaccgatgcaacacatcctcaaggtttattgaccgaatttgtctgagttatattcattcagctacacctaacaaaaaaggactcactgccttgcttgcaagatatgcagcttattggagaatgctgctggttcaggtccacatctatcaataactctaaatcctatacatcatgcatccatggatgggcatgagtagaaattacaacatagctgaagctagaagacaggttttaagcaagccttccacataaatagctctacaatcgcatccctagcgtgtcttgttacgccttccatccacaaaatctctctatcctttgacaaacctgccccaacaatctctcaagatgcagttctcatccttcctattcgccactctcctgttggctgcctccagcgtctgggcccaggacttcgcctctgaggaaccccgtacctgcctgagtgtctgcagagcggagaagtttaagtgccttcccggcatggagcctgaactgattgatcccgagggcgacaaagtaagtggccactctacttaccctgtagcttgatactaatgtgtcgaatagccctgctggacttgctgtaacaagaaacaatgaaaatttaccacaagcgaaggtgaatggctggacttgaacttttacctggaggacaccatgaattcatgatcccgtggcgtcaacttttgtaaagtagttattccgccttcataatctggtaaaataatagtattatccatcgttcgaagtaggactactaccattctgttgattaggacttcggtcacaagtctgtgtttttatccatcgcataataaatgctcggtgggtctatagtcgaaaatcatgtgtccaagagcaagttattctgcgcataaatgagaaaaacagttgccttagcaagcagcagttgttgtattctcaggtgttaacgatctagcataaccaggaggtacacatatcccactttaacacgatccctagccaacaattcccttccccactacactggaaccctttgcaatgcggagcactcacatccaaagcaaagtgataaattgtaaatgtttacggcatcgaagcacggcgcctcatcaagacgctatcgggttacaacctcgcactgaggttcactgtaggtaggtccaagcagaagggatggccactcctatgggaggaggattcttaacagataactatgcaggggaaaaatatatctactccgtacgagtagcagggaacaggtcctaacaaacgccagccggggggaggggggagggggctgctcaggtagccactcatctcaacaaaaagcaaccgtgaacataaaataaccgtcttcgttcttgacgtaaggagagggtacgcagtaggaaatgttcagatatacagacccacctcagccagccaccaacattgtgacgcttcagcaaagcctagcagggctgcgagacgctgtccggttcacccctctcgcattctcttcgacctctcagcaagctcaacacgctgctaaacagtccccaatcttctacctaaatccctcccgtagtctcctcagtatctggatcatccactaggacgtaattaactatttattctgcacgcgtagcggtcatggtcgagggatctgcgggtcttggtgtgtaagaaacaattgcagcccgcgcgtagctatgtcaacaaagacgtccgattcctggctgcagatctgtgaagctttctgttggctattgaggggccatacatacggcacaatcagccttaccgttcaaggtggtccttgtcagtctataccgctatatgctttaagatcggctttgaagatctcccaagacgaagcaagagaaaagggacagacagaatttcagggtatcacgagggcataaaaaatactgggttgagccattcttgttctctattattgggggtaccagttattccgattccagtatacgcatatcaggttgcatattgctcttgccggttgtcagggcaactgcatcattccttgcttaatccgtaccccgacgtgctctctgccctcacggcacttcccgttgagcttggagcaaccccggttacacctacaactaaagggacaaagtacaaagattatagtggcttggcaattattcagccattggaaaactctgggttggcttgcagatgacaatgtatatgaacaaatgtatttgataatagttgttgcacatatctcactaaagagagagcaaggacctcatacgtcaaaccatatgtagctttccacatttcacattgccaccaataccgaatcacaacgacagttgagagacgtttggtttccgtttgtaagtcacatctaataaatgatcgggttacccgcatcaagtctatccaggatctaaaatgaactcgtcagttgggcgtcaaaaaggaaatagaacaccggaagccgtacccattggtcgagttcatgttcgtcgttgtatctgaggttctcgaattggctatccaaatgctctggatttgaacgttagcctggtccgtactatttctccttcggttccacagttatcactcaccagcagttacattgacatgatcggggacaagatcattcagctgccagcttcccaagaactcggtagcctcactcgcgttgcctatttggctaaggtcgtaacggacggctgcgctgggttagcgaacgtcatcgatgtagacccacgacgaaagcctaccttcgtctccgtagcctttgtccttcacaaacttcagcgactccctgatttctttttcgtatgtatctttaggatcgtcggtcggacatccgtcggtgaccgtcaaaataagaaggggccggtccagcacttcgcccttattaagtggatcgtagagtaagtcactcaagactttagcttttaggttcgcacccaacggagtcggtccattgggggtaaacttcatcttcgaggtaagttcgccagggctgattttatcgaatttctcgttcttgttgataaaccgaagataaacctgtgcgttcccttccggagcagccctcgtgataaggtctgccatccgtccaaccatcgttgcttgtttgttcatgcggtcgtcatcagccatcgagccactatcatctataggcaactagtgtaagtatggtgttcttatgcgatttgccgactgacctaccgcagtaaaagacaggctggtacaaagcctggcgtgacataatagtcacattcctgggtgttgcacccgggaaagtcgaatcgttcaggatcttggctgctttctctgctaccttatgcacatactcattaccctctgggaagatgtcctcaagaccctttgcatggatgaagttttcaaggttcgacaggatttcctccgccgtgcgggggttcgtaatttgctattccagggttagcaaattcagaaacgaagaactttggatgacaaggtacatacgcctggcactggttctgacaatgcagcaagacgatttatggcattcttgccgacgtccctgaaattcttgaagtaggccatggcaaacagaccggagctaacgagaagattctcgagttctggcttccattccggcttctcgtccttggggcggatagccttgtgaacggcagtgtttgtagacttttcggcaaggttcgcaggtgtctcgccgagctcgttcgacctatccatggccgctccagcctgaacgagggcacggatagcctcggggctagtgccttgtcgaatcgctgacatcaacggagtgtcaccttttggccgtgagaccggcttgtctggcttggcaccgtgcttgagcagaagctcaacaatgcggccgctgtttggtgccagagtcgccgcatagaggggggtcttgccatctggggatactctgttggcatccgcatcgttctgcagaagcagctttacggcacccacatggccgtttcgaattgccaggtctagggctgtatcaccgtagctgtccacatcattgacttcgtcctggatgaggagctggccgatgttatccatattgagagttccgctcttcgcgtgagtgtgaaggttttcttccattatgaaaacacctgtcgcgatgtactcgagagttatgctgagctaaggccaggttaattagtttaacaagaatgaaggctatagtctatcggttccatagccatgtttatacccctaggtggagccaaagacgcttcctgtttgcagctttcagacagcctcatttgtcccattggcacgtaactttgcactcaggcgatacatcacctaaattttcactcttcaggagaccatctcgttctaccgacacatgatgagccaatactcggccacgaacctcagggtagtgacgctagtgacgtcaacacgaagcgcgacttgcctggcccaccgtgggtcatgaccaggtaacttcaatgtcgcatgatatttccagctgagaattcagggttgcacggcagcttccctgcgaagatcttaaggtgaccgctagtttccgcaagagggcccgctttcagctgagccatctatacctcttattgacaactgattggctctgatgcagtgtaacatcatgttatagcattctgcattcgtttatgtcaattatcgacacgcttttcactacttcgtgaacagattcaaaagattgttggttgcactcatgggctgccgagcatggattttattgttctcccgctgtcgtatgatggtaaggttccaaaactctgtggatgattaatttcaactacgccatatagcgatatgtacatgttgcgcaccttctgttgattgctggatttcagaatgaggaacattttataagcctttcagaaggccgtcgaggataaacatgcggatgtgatgagtctgctcacgtattgcgggaatgatctgctgatcgaggactccgggggatctcgcctaaatttgtcaggcaggagaaggaactgtgtgaggagattgaccaggggcttatacctgacggatctttactcgttatatattatatacttttcatttttgtttcttttcttttcttttcttttttctcaccacttgtgatcttggcactcgcgcgacctctataacctcaaaatgcgaccgtcgctctggcgctcaaatgtgcaaataggagctgtaccagtggcatgacattattgataggttcgtctcgagacccgctctttacggaacgggccgcgaattagagggctcggcgccggtagcattgaccactggctctacctacacaacataggtatttaggtaagtcatggccagtggcaaccaagagtctttgatgcaaagctggttctggtagttctgcctgcgcaataagcttgtcaggacaggtttcctgatcctactgtgcagggcggctatttgaaaagaaaaatactctgctatcagtctatcagattggtcaattacaaagaaaaacgaaagcagactttgcatttcaattacagtatcgaaaaccccaaaaagtaacatgaaagggggaaaaagaaggaaagtctacctaatatcatggcccaagtaatcgtccaagggaaatatattagtctgctggtttcgcaggtgatttcctccaagagtcgactgtgattattgccgcttccgtatcccagcattctatcctccgaaagtaccttgttgctttagacagccataaggttgtccagctgtccgtccagctttcaacttaaagaagctgcccagaactccaatccgagtgctgagtggggaccatgcccttcccggtagatcgcatgtaacaggtcttgtctttgccatttgtcttccacaggaatcgcacacactccttttccttcgcgcactgctcggcgcagtctttgaaagaggccgctctgggagtgcggaagttcgctacgtcgcgggcgtcatcaactatctagaagtcagcatgtctctgctataagaccttattgagggaggcaaacgtttagcatagtgaatcttgaattgttcatctccagcgctgatgatgcattgatcgtcgccaggctctgtgacccagtggtcagttccagttgaaaagctagggagtgacattacaggggtctaaggattttatcacttaccggcttcgacaaggttcgtacggcacttcccgccaggggtcgatgtattgcaagcgtttagcttctcgttgagcgatttgatctgcgacttgagttcggagatctcgtcttctttgtctttgagatcctgattcaagcggcttctgtcgttctcgcactggtgcttctgattgttgagctcggccttctctctctcacatgcacgttcatcctcgcgacactgtttcctcttctcttcaattttagcagagtcaagccggcactcctctgcagctttttcggattctagcctgccgagttcgcattgcttcaatttttcagggtccacctggttgctttcgcacatgtcgagatcatgctgagcttgctctaggttatcattgcagattttgttatcgtcaatgcactggtccctctctttagtgcacttttcgcactccggttctggtttggggatcatgtcatcgtcatcttcatccttctcgactttaacgagtgacatgaatttgcgcacaggccgctgagccttgttgttgttgtctgcgacgaagaagcagttgccctttgcgttctcgtctagagttcgaaaggaaatcgcctcacagccctcggacgcgcagcgcgaggcacactcgaaagcgttggctgcctctatttgggtcggcttcacgcgcagcatggtcccgcaggtccatttccatttggcattatcaatagagacctcgcctttttgctgtgttggatcactgcagcaagcgttgcggtcattggactccaagcaggatgaggatgttgatatttcggtgaagctaatccagtttccatcgtcctgatggtccatgttgtctcccaatgtgaagaagcagttcccgcggtttgggttgccgcgtgtgttgaaggatgatgcttcgcaggacgggtcttttgaacagtgtgtcgcacagtcgagagcattcttggccgtgaagggtttgccgaaggagtcgagtgagatatatctcgatccgcaagtaattaagaacgtgcggtggtcaattgtcaccttgtcagagggcgccccattgaggcagcactcgttaggattaccggttttcaggcattctgaactgccgccgatcggtgcttggtcggcgaaggccagagcggcgcctagcagtaggagggatgatttggcaaccatggtcaagcaagaaacgaactctggttgtcgtggaaagacaaggacagcaggaagtgctcaaaaagcttcaataaatagtacagcgacgaggccatcaggccgtctacaaccctttttctcgccctcgcgttgtagccccaccccgatactcagatatgatgtaaagtaatgctgtcattaaggagagaggaggtgtcagggtcatagatcgagtgacaagttacattggtagacctgaaagtgggtagctaggactctggaatgctcagctgaaccagttcagctcagccttctgccggatgtggagctgtgagatcgtagatcccccgacatcctaaaaggagggtctcagccatctactgccgaacgaatagaatcgcccaaaaggtcgcaaaataagggttgctattgagtgccagtgaggttgctacctgcaaggaggctacatgaactatatccaattatccaatgctctctgcaattctgcatgcagcgtacattgtaggtcctacatgatgctttcatagttcgcctaacaccatgctctttttgtatatttcatttatgatcatcggggtgcttaccctaaagacactgatgtagggaagggtggtattggtctactccgtataccctcctaggtaacaaccgctgtaatagcataggatggtgaagtaggatcttctagatttgcccggtacctccggggctattcttacataagggagaagactacctactacgtaggtagccatggatggatgttttgcgaatctgaataccaggttactacacgcacaagtcgtcagctcaagcactttagattagctggaatgaatgttttcctgctgagatatgaaagtgtccagtttagttagtacagctccgagcacaaaaaaaaacattctagaagaccgaaagatatactctctagccaagaaccaattcgccttctcagaaagtcgaaatgaacagacgcttcaagctttatatatatttcagtgaacctggattcctcagttggtatttgagttaatacctagttagcgtgcggctccgccatagtatagcaatcagcccggatgacttggttcctgtcatctaagataaaaccaagctcctataccactctagcatcgtcaatcaatatcttgaggaagtctataaaattaaactaaaaagggcactaagattcttgttggatttatggaatcttcctcagacatagattacacggccttgtttcgggatcagctagctatagtgatgggattcttggagcaggtcggatatcaaccccagatgagagcaattaggtctacaaggttctttgctttcttcccgtatattacatataacaagtataaccaagaaacaatgctatactataatgaataaaagattaagaaaacagccaggtaggaaactacaggcatacaaatatagcttgttgagttcagtaagttaccaattgaagcgagctggcctaaaattatgaggcatctaataaaactcaccgagtgttccacgaattctgggcggcgttacccttcctattgccaatataaatatgggaggcagtttgagtgaccgaataaaaagaacctggttaagcaatatttgacggttgtacatcgttatataagtgtggaaggatgagagctctgggagaatacgtctagatagtgcaacgtgagttcgcactgatatgtcgagtcccacctagtgaggtatgatcgcgacgggtgtacaaaggtccttgccaactagtgcagtcagctatcctatggcccgaatgtcggcagttagcttcagctcacgctctccgacgagagaggtcaatatcaggcagaaccggtattttgacctctagtgtagataacaaaaaggcttatccgtttcggtgcttgcccatattctttcccggcttagaattgacaggttgaaatataacagatacggggtctaattccggtctcgaaggtaaggatgcccgttgtttcagccgtaatttggttttttcttttatgtaccctgcgagacgtcgcactgcaacaccattggagtattatgcccacttgtgcgatttcacaggatatggatcaactctatgaaagctgacgagacattgctcagctggccaaacgagaataaacagcacttacacatgacttggcaaacagtgcagtgggtgcatgattgtatcttcgtactgaaaatcccctgctaggtgtgtcaaatgaggcgaacgacccgagagcaacttgcgaaaaccgtatgaacaataacacaggccaaatggtgggtaggggtattccattcctgctttccctctagctaacatagtatttatattcgcctgggaaccatcacaggagaattgccatttttattcggttgctggaacatgtccgccggtgatgtgatattctcgcggcaaccttgggacgtatgagctccgaaatgtccatcgggatcatccgggacattattacgcagccttccacagaaactgtcaaacccgaagtcctatctagccaaagtaaccatgttcgggggcaataatttgttgcagagccctctccgttcacgctccccactgccaatatcatctccagtgcatcaacaagcctgaacataagcaaagcatgagaaagaccaaccatccgtcgtcaagcatgggccaaaaaggtctgccatctatatcaaacccctcgtccttccggttcgtctcaggtcaaccggtgaacgatagcggcaacaacaagaagcaacacagcgggactggatatcacgaagatggcatggagaaagacctggacgagctttctgacgaagaatggtttcagacaggagttgactttgttttgtcgtaagtatccgtatcttccgttgatattcccaacattgtcctcacgaacctggagactggaacgaccatgtctgtcgcatatctcaagcccacagccttcgggtcatgctgtgtcaatgcaaggcacgctgctacaacttgcacccccaaccctcgacagcgactcgcgatggcaggtttcggcggaagtttttcaaaaactgttcgagatggcggacaagcttgacttgaatgggtacattactcccgtccaagcgtggaacaggataagggaccatgagaacttcccacgattgacgcgtgagacattgaaaacactgcagaatgccatgaggcctcatatcaagtgtcaggggtgagtagcttgcttttttctcgattgctaatttgtgtgctaatatatactgcagattcgcagcaatcatggaggaagccattttcgagatattgctaaacaaagctcttggtccgtgattaatagttcttttaccaaatatttgaccaagctttgatttgatgcctgtttcttttctttcctttttcccacttgtattatctgccgttgccaggcttcaagaatatatttcgtgccttctacaaagacccattgtgttattcacactgaattagtagataaactcttctagaaagctccgcagtcaggtcttattggccacaatgcttgtccatttgcctatgtgccttgataaagtaatccaaatattcatcagactgataaaaggggacaactagtaagctggtgaggagtgtctaggtagcgacaaaacccgagccagcacataatgcgcaaaaactacgcaaaaggctccaagcttttgactgagataaaggaactaggtcgatggtcatgaaacacagatgaaaccgtctgttgcgggttttttttatttatgacaagtttaagagcccttggtacggtcgaccgctgcctgttgcttgtaattattcttttgtctcgacgaagtcctttatgagccatgattatatgtcactgagacctctgttgtcatgttgatattttcacccttcggggcaatagtctctaggattgctgtttggcttcccatatcgtggactgtcgtatgtccaatgtccgtctgcgtttcgcccttggagttgtcgaagaccttgcggttgggatacgggatcatgttataattgtccgatgatgtgttggggaatatcatcgttaagagaggcctaagcgcgggaatagatgcagcggtgatagcgagaccatcctctacagctgcccagatcaataagggagcaagttcccctaagcaaagagaataaattagttttatggcgaagatggagaagataacaattggtgacgtacatgtgaagtcggatttggccgagagcgccacaagatgtatggtcttgactatggatgctgcgcctgcgcttgaagagacatgtcagtcagtatgtgggatcaacggtgtagggtctgcaagacttgcaagattccaaggctcattgcgaaggccacagcaagcttttccttctttctcatttgcagtttccagacaatagtccacggtagcagtgctaagacaaaatcttgtgctccagaataggctgcaggagggaattgatgcattagtcgtcaataacgacccaagggtttctgcaagaaaacttaccaccaacaaagagagcgaaattggtaaagacgtccggcggccaacactccgatggaatcatcggattccacaaatgtcgaggatccctgcattgcaggaagacaaagagtgcagccaagatgttgacaatgttcattgtaacaatcacgaaccatagcacgacaaccatccatctctggaccacaatccgaagtaacgtgacagcaaaggacgtcttgccgagggtgcatgccatgattgccaaactttcgccaatattgcacaagagggccacctggatcaggttatttggggttttctggacaatttcgaggtgttgtcctaagcccagggttgcagcgacatggcagacagcagcgtatgcaacgagacaacactatcaagggattgaagtcagtaaaatcatctcaagtccgacagtcacgaaaagagaggagacccttacgattgccgcaattgcaatgccgtcatcccagccaaacactctccgcatgtacactcgcacatacaagcgcatcaaaacgaagaccaaaggaaccatcgacatcgtccacatcacacccttcaccgtaggagcctggctctctatcgggagatgtgcacccccattagacgacatcctgagcgttcgccaacgctgcgcagaatcacagtccggggtgtaccgtaaatctagagattcgacttccccagacgtgggcatgccacgaatgattacacgcgcatgggactccaggagggttgagcattgtcaaccgggtgtcataaaagctacctaggtagaacactagcccgtcccaagaacatggaatatgggggcgaattccgaaaaagttaatatttgtcacataaagtggagctcatgttttctaggtggatcaagaaaacatccaagggatcgacttacgccgctttctcgatttgaaccagtctgtcatccatggcttatgcttggattcgcttaccatggtagtggatttgttaagtcaacaataataatcattttgcacgagcttgttcttaaacggctaattagagccgctgtcacaaagccatggtatctcgtcggacgctagggcggcgccgctggagagccaaggttgttatggccaaattgggaaattggttttatcgaacagccattcacgatcatcggcaatcaatcaccgactccacattccgttcacccccgtctggagacgaacgctaaatcccacttggatggagttcccatgccattggagaattatcaacgcttgttcgcgccgttcattttgttccccgcaatggcccacgttctcacgcctggtgttaaaaaaagggcaaatcacgccccccataatctcagcagcactagcccctaggatctccgaggggcttttaaatgctgcgactgtcaaccgcgttgccggctcgcgaaaacctgactattggcagtgaatcgagtttggaatcgccttgctacactgcacgtacttttgtgtgtgcacagaatccacatctgccacgatgtcggaaatgatcactcttccttccagcctgtgggcccaggccctggtcactctgggtctgcttgttgtgataaagctgatttcagatgtgttcttttcgcgcttgaggtccatccctggcccagcattggccaaggtcactgatttttggcgcgcgtctcacgcatatggtggacgcattgatctcaagaatgtccaattacaccggaaatatggcacagcggtacaggtcgggcccaattgcgtgagcatatcagacccgaatctaattcggacaatttactccacgcgcaatccctggaaaaaggtcggatatgtcatctcctagtcaatatcgtccttttacgtgtgagagtaggctgtgctgacctgttgtaatcatgtaaagagtgatatgtaccgtcccaatgacgtgttgctcgaaggccatcgactgtcgaacctcttcaacacccaagatgaagattggcacaaccagaatatccgacctattcggagcctttggtccatgactaaggttctggaatacgagccttttatcgatgagacaataaccaagtttgtggacaagctagcgctgagattcgtcgatggcgataacgcaggaaaggtttgtccggcagatgaatggattggtttctgtaagcatactctcaaagatcccaaacacccaatgggacctggcatagatagaacctaacacgcatagttgcctgggatgtcaccgccaacttcagttttggtcggcattatggattcattgatcaggagaaggatgtcgacaatttgatcacggactcgactgctggcctgagatacttcgcaccggtaaataccccgatataaacgattcgacgtggctgagggtaactgacacgtacgtcccactaggtctctcaaatcccgtgggttgacaacatcctcgacaagaatccgattaagcgaattgggcccaagcccaccttgacaggcgtcctgtacgccttcaaagtcgtcgccgaataccaagcccagctcgctgaaaaggaaatacccgctggtagtgttgaccacaccctagataaatacgtgcagctgaaagaaacgtaccccgatatggtcgacgataatcagattgtcaactggctgatgctgagcattcttgctggaggcgacacgagctcggccaccatgcgtgctgtcgtttactacctagcgaagtcacccgctgcgacggtcaaacttgccgccgaactccaagccgccggtatctctgcccccgctccatggaaggagatccgcgacttgccgtacttggatgccgtcattcgtgaagctctgcgcatcaaccccggcattgccatggtcttcgaacgtgtcgttccggagggtggattcacgcttcccgatggacgatatctccctgcagggaccaaggccgggatcaacccctttgtcactaaccgtgatttcggagtgttcggacatgacgccgatgacttcaaaccggaccgctggctacagggcaagggcgaaagcccgggaaactttgaggatcgcctgcgtcggatgaaggatactgtcgacctatcatttggtggtggaggccgcgtttgcatgggccggtatctcgctatgttagagatcaaaaagttgattgcatcgttgtacagctcgttcgatgtaagtggttcattgggattcttcggatgccagcttcttggtgctaactcggggtacagattcaactggtggaccccaaacatgaatggaactaccaaaatgcctggttcgtgtatcagtacgatatgcccatggtaattcagcgccgatgaaatggggtgctcgtgtgccaataatggacggacattaacaaatacgacatcatgaacgtgtggaagctaagcgaccagagccgggatctagcaaaggtctaatggatacgcggaagatctgaaatcgcatgcgatatggattgagtagaaacgaatttgtccataccgcatagggtatcaaagtcccagcctagaaaacgccgctaaaccattaagaatatccaggcccttggaaagtccccgtgcatcaagtcattatgtagtaaagaatcgctgttacttcgttcaagcttcccgactgtccatgcgtaacttcattcaagcgtacctcgccgtccaattgtgttcggtaatggtacgtgggtgtgtgcgattcatgtcttgagccgctcaacgggaaagccatgctcatctttagtcatggcttcatcttcgtttttctcacctggttttccgtcattgccttcctcgccggtaatttctccccagccagaacttcttcgactcatgcgaccagtcatagccaatggactgctaatgcccccagtgatactggcggcggtactgtcatttcgactgtgtgattggacaccgctgcgaatgctggccgtatcgccgccggtggtctgcttagtggtgtacaagccaccccgctccgcagtcgtgctagctagcggaattgctccggaggccgagtacacactgatgcgttcagcactagcaagaccaacaatacttggtcggctcagtacacccgaggtattgaacacagaggtattcgatgcttcagtcgtatttccactcagaacgctcagcggcaggctctcccgactaccgccgaaaacagaagagggagccaatccgcgtacggatgcattggtatcgagggagttgcgccgacgacgcttggatgagctcgccaaggtgagaagagaagcgttatcggtcaaggcattgtttgcggttgcggcgctgtacgtcatcgcatggctttggggcacgaggtgtggggggactgcagtagcgggtgaggttggaggaaattggtgggaaaattgaatctgctggtttgaggagctctgtgtcgagctgccatggtggtgtccattgtggttgttttgtgtgttgtacagttgggttgagggtgccgtcgagtgcacagtggtcagggtagtggtcatggatcgaatcgaaggtgcaggcgatgagaaggtactaccctcgccacccccatgggtgctaaatccttcagtcccagttgtcaatgtgcctgccttggaatacgccgcttcggagaatgcggcgtcgccattggttgaaatagttggcgcagcggattttgcgctagtcaggggagccggattctcatagcccgaacacaaagatgggtcgctcctggagcgagatcctgcaccataatggtcatccgtgtatgagtcggtcggtgtctgagtccctgtgtcacggttgatggttccagaaagcgggtatgggttgttttcttgatcgcccttcttgcccttattaccagtgtagcgcttgttggaccatcgatttgtcgtagaatccgaggaactcttaaggttcgccaggcgtttcacccagttggagaatggacggcgacgtgcattccggtctgttttgtatgaatcccttagcagcggttcacggtggccaaaaagcacaatctgaacttaccatgcaccctagcaggaccatcggcagtagtcattctagcttgaagaggcagcctagtcactatcctctctggcttgtgaaaggtcaaaggtaggcaagggagcagagccctggggatccagccgcgccgaggcagatggagcagcgggcggggagactgtttatccgtgcacgtcatgtgcctgccttcaatgttgcctctttgacttctatttgacatactctcaaaattctggacgttgtatacatttcctgagtcatttatgatacttatcgggagggctcaagcagcgacaatggcatgtgatcatgaatgaaactcttttagtcgtgtttccaaaatccaccttgggatctttcttgcatctagtggcgcaatgccccggtgaatacaacaactgcgtcaatgcctccttctcagtcaatgatacgagcgctaccttctgatgtgattgcaaaggtcaaatcatctacgtccattgtgcatctgactggtgtcattctggagctagtcaagaattctttggatgctaatgcacataccgtcttcgtcactgtcgatttcaaacgtggtggctgtattgttgaggatgatggcgaaggaattcctccagtggagttcgaagttacaggaggtctaggcaagcctcaccgtatgtctcccaaccttgacgctataatgtatgctagctaacatatggaatagatacatccaaattcaacctgggtggcttgtatggccatcggggcttgttcttggcttccctggcctcattgtctctactcactgtaacttctcgtcacattgatcatggatgcacaaactcgatcatacttcatcattcgacgcctgtggctcggctaacccctgcgcctccacatcatgcgcttcgctctgtcgaccatggcacgtctgtgactgtcaacgacctttttggaaatatgccagttcgcgtcaagagtcgagctctcgctctccagcgatcagacgagctagaacgtgagtgggaccaactcaggaactccttggtgtctctccttctagccaatcatcaattctcaaaattagtcttgatcgatgtggaacgaaataaaaggatgtccgttcgtcttggaaatgcctccatgcccgaagcacgcatctctcatgatcagagggagttcgatcttaaacgtatcgggatggttctcacacaatctgggctagtcacaccacaaaacatcgattcttggcatgaaatctcagcatcagtttctgacctcacagttcggggagctatatctctccagcccagcccaagtcggaagtgtcagttcatctctttgggaaaagaacccctgctgtcccacaatggctcgaacgtgctgtataacgaagtaaaccggctatttgcttcgtcagattttagtaatgtcggagccatgtctaacagaagctctgtttcacatattacaccttcggtgaatcagcttgatgccgcaagtaacgcaagtactcgaaactgggcaaagcctgtcaataagtggccaatgttctacgttcgcattgacacaaacgctgttatacggttggatgatgatgatgcatctgagcaccttccggaatctgccaaatcagttcaacgtataattgatgtgcttggggccatggtccatgagtttttgaagcaacacgatctccgccctcgtaatggcagaaagcagaccatttcgtcagatcaaaaccagagtatccgttccaaagcctccccaccagctggcggttctcatgcccccttacgacatggtcggtcgatttcgagcactgaagaggcgtttagcggtcgcttgaaaattccctcatttccaagaacccagtctctgaactctggtcaatccttcaacaactggtccagagtgaaaaccgccaaggatctcaaaagacgttctccgacccaacgaacgtctgggctttctcatgcgactcctgatgtaatgcagggcaatagctccttgctgattcaccctaaacataagccaaatcgtcgagatgatggccaggagtgcaccatccttccaaagcccccgtatgaaaggatccgtagtggggacaagggggatctgcctggagactcaccatcagacaagatgatcacttggatcgatccgcacaccaacttggcctatatgatcaatcctcgaacgggtcaaacaatgaactcccgcaagtcattagctacccagcgttcccccactgactgtgtcgaacgcccgtccaagaagcctgtgcaaacgttttggatagataacatgttgggggcatgggacaacccttccttcagccgaacagaaataccaataccaaatctaggcgcagaggccgccggtcagcagagtacagctacttcttcacacgactgcttcaaaggcattggatcacttgatacagcgcaagttgccaaatatcgagggaaactccaacgtcatgcgctcgagactgccgacgtgatagcccaggtggacagaaagttcatcttggctaaggtccgtacggcccccatcactcgcaatttggaggggccatcaaacgatgttctgcttttaatcgatcagcacgcggccgatgagcgatgtcgaattgaacagttattcggggaaatgtttgtctctgctgggcttggtgagaattgggagtcgggtgctcgagtgcgaactgtccaagtcgtttctttggcatttgaggtttcattgacggagggtgatctcttccaaaagtatacgagtttcttctcaacctggggtattgagtatgcgacacaaggcaagaccaactctactgccttgatcaccattcatactcttcctgtcctaatagccgaacgctgtaggctcgagcctcatgtgttgattgacttgatgaggcgtgagatttggtcaagtgaggaagatggaaataagccgttcctgtcgaagagaacattcgaacaggatatcgaactatcagacagcgacgatgttgtacaccagagatccgcctcgcgctcatgggttcaacggatgaatgggtgccctcaaggcatcgtggaccttctcaactcccgcgcctgtcgcactgcgatcatgttcaatgacccgttgaacatcgatgagtgccaggcgttggtctccagcctggcccgttgtgccttcccatttcaatgcgcccacgcccgcccttcaatggtccctatacttgatttacgatccctccctgagactgctgtttcattgccgctagacttggataccagtgcatccgcttatgatgataattacgacacgacttcggatttcgtggaggcgtttagaacacgttatgtaacataattggttagttccttggaaggctcttctatgggaaattggggattctggtaattggaaatgcgcgaaactggacgaaaatatgtacattagctgatacatcaatcaagatttgccaattattcaatctcgaacccaaaccactcgtctttggcgctcattttgtgaattctcctgtttagttttagggttttgtggactgcgtgcgaataagatacagactcggcatcactgcggtgatctttcgcttgcatctgcctatcctccttacaatgacagcccagagtctcaaataaactgacatgaaatccctgtcgtccactttagcctctaccatgagcgctcaaacctgttttgaaggttttacggtgatatgtcacatttcctccaactcaaattaacaaacagaatacagctcgggttttcaatacatcataaaacaaacgattgaaacaaacaatcccttgagtgtttacgtcaagtctagatgtgacatggtgacatagcgaggtgcagctgggcactctgcatagtactcaccctgtacggagaactccgtaagcctgatggatttcatattcttgcatgaacgcgcatcggccagatagatcgtgcaggacatcgaagatttcagtttgaaattgacgtacatatttcatattttgcaggggtccgacgcttacggagtatccataggcactcgcactactcaaatacctcgacgcaattgcagcggtctatcggctgtggtatacagtcgagggttttcttgcattcaaaactaaggtgtcctccgcgtatctctttgatggatatgtattgtcaagaaacccctccgtagacttggcggaggggttcatgcaaggatcagccagccacggacatagtgatagacggaatggcactgcggccggtttacgcggccttgaatagcgatgctttatgatatgatatgaataccatcaaagcataaaggcaatacaaagctcgtatatacgtatgtatctggtatagcaaacatcagattggaacaaatgatggtacttccatgaaccttatctaaaagctacatctatacttttgtaggcctcagggacgttcattagataggtctgtcaagaggtcctagtcaagcgtatttattccaaggattttatttccgctgcttggtttacttttggtgtttggcccagccttaaaccgcgaataagatctttgagctcaaatctttcggatgcgtcgcgctggattacgggtcagttggtgcctgttgatggtgggctctcactggtacggtagcttttgagctggcttgtgggcttttatttgaccatcattggtagtgatggttgcagtcggttttctatatgcaggtctcagtattcaggcagaaatatgaaggcagaatccggggtaaatcatcgaaagtccttaatttggatagcttgggttacttagaaagcccaaatattcactacacgaggcaaaagcagggttacagctacgattgacacagaaacaggtaaaactaaagcgtattttgcattttaggcagcttttaagagttgctcctgtacagaagccgtgaggcaaaaatattgtctagagggtatccgatgtaggaaacgcccagttgacagataacaatcctttttcccaacctgtccttgtttccccagccgaaaataagaacagacaagaaattaaaacataaacagaacaagccccttggtaaactccgtttgggtagtccggggccccgttccatacatagccgcttttccaatgctacatttctcaaacgagaaattgcaaaacaaatcaaacacgcaagtaccacccaagaataaaaaaaaaaaagtaaataggtaagacaagaatgatgggatattcacagatcacaagaaaatgggtttggggggaagataatgcaagtatgcatagtagaacagttaagatgatgttggttagaacagtaaatcgggaataagaagaggtcatcagtcattaggttgcgaaggatggtgtaggtgattgcgggtggaagggagtgatttatccgtgtgtcgtgacggatttcgccttggattggttggtccatgagaggaagtcgaacttgtccttggcattgtcgagcatggaaggaatggactcagattgggactgaagagtatttccgctgcgggagggttctctaggctcaagaactagagagcggcgatagaaggtttgtgcggttgtttcaccgttggaacgcacgcgcacgagctcattctgcatccaagcctgaagctccggaacttcggttagacggtaggggatctggaagcgttggagctcgctgataatgcgagctgtcttcatgtgcttgtcgaagttgatgacagccatttcactgtcgtcggtggagagcgtacgaagagattggttgccgtggtcgacaaaggtgaggtcggtcaggtaggtgccgacgaatgggagacaagggggcacgtgattctgaaggcgttgacggagtacggcgtagttgcgggacacatccacgatgctgcggagctgctcgagggcagtcttggtcttctgcgatacgatgtcccaggtcttcttcaggcgagatatcatagacaagttcaatgaacaaatgatagccataagggagtcgtagttgttcaactccagacacttgttcgcaatcttgacccagtgcttgatggttgcggcccgctttttgggctcctcgaggtacagaatggagtcggcaacgaggtgggcaagatcagtcgacagagttgacatggcccggacattcacagccaacgagcctgtcttcctggtccattccgtgtccaggagttcttcaggaaggatcgagcagaaaatacgcgactccttaatagtgagctggcgggcgagctcgagtgggtcgaagtcaagaatggtaattgaggcctcgccgttcttccattgcctaagcaagttgtgttccttcttgccaaggacggggggaggtaggggggtatcggggtgaatgtattgggcaatggaagtgttggtcttgcccatagaagaaattaagcgaggcacaagcgggccaccaactgcggacaccttgttggccagatcaagcaaccgcttaccagcagtggggagatctaccataagtcgtgtgtttgcgaagttgatgatgaagtcaagggctgtgttgtcacgatcgtggcgccagtgggactcgagccagcccttgaagatgttgtatacacggagacggacaggtccggcggcatggggtgtgtcaccaatgtattcgaagcgttcagcgagggcctcggcaaactcaagaggcgtagtgaagagacggaaggtaaggtagaaggttgagacaaacatggaatcgggggtggattggtgagcagtcagcttctcaataagagcacgcagactaccgcccatcaccgaaccttctttgtaaataagttcgtgtgcgaaagtcttttccaggatgttggcctcagtctcctcgttctcctcggcgagggtcgagtaactcagactctccttcagtgagtgaacggtgaaactaccttggaagctacccccaatatcaggtgaggtagcccgagtcgaggtttgcgagacaccactcatctcagagtcacgtgtgtggctgtgatatgtgaagctgctaccattgctcgtgactccacgcccaaatgattcgctcacgtcagacttgggatgactttcagggtagttgctgtcagcagaggagaaagaagagatgttatccagatgggtggggaggatggcagaattaggtgttgaagaaatggcggtggtgttggcgggagaatttgagagacgagactggaaggatgaaggtgttgtagagtcggtgagagcaggtgttgggggagagtatgtggtggtgggaatctgaagaggaggtgggggaaggcggagtgacaattcctgtcgctcctgttctacgccagtctccggttcatcttgtggagaggcaatgccaggcaagtccttgcccctctcttcaaagtgttcagggtcaagctcaaggtcaccaatttgctcaagcaccaggcgagccttcgccaaacagtttccagctgctcgtacacagtcagtggcagcatccacaaggcgtttcccttcgtctggcatgaacacaagatcatcgtctggtaggtgtgcggggcggaacacgtcgcgtgcagcgtggacaagctcagatagcttctcacacattgactctcgtgcctgttcgaggaacacgctgcggtgggtgtcatgctcacacaccacctccacgacatttaacaactgcctacacgactggacagcctgctgggtggtgacaaccaactccgtcgaggagcgggactgcatgtggagtccgataaacgagccaagcacaccgaggaaggcatcatatgtcgtcccgaggcgttctgatgccaggttctgggcactgatggcagtagaaggacctgaaactgacatacggtgagatatagaaacccgtttcgtagcgacggagaccggtctttgatcaaccatctcagtgcgcatcgacgaccgactcatatccatacggctgtggttcatttgccgcgattccatccgtgattccattcgtgattccagcattcgcgactcagatctagcaggcccatcgttctcgcccaagttgaaactttcggatgcaggggtcggtggcatgctatattggtctatgctgtcgccgggtccatccatctcagcaatagtcctgctcaagcctacctcctcattccacacgtcgaggaatcgaactcctcgggtcacgatcttgaaagctttgagaagcatctcatccaaaatggcctcaacctcatcttccgaaggaaccccgttggcaacttcctggaatttcttcgcagttttcaccagcgaagacaggtcagacagcaaagccttccggattctgcgtagtccgtcgaatctccttaccaggggtgactcccgggtaagacattctgatttttcctgcggaattataagccctgtggtgttttctcggttctaattggtacttaccagtaggaaccggacgccagcgataggccctctcatcaagtcttggtttccaaaatcttttagtgatgacccgcatcctcctcgaatgatatcccagaaatcagtcaaggccttcaataaaggacgcataggtaattgatcgtatgcttcgcagtaattcgtgggcaaccagcctcgattcccagaatctaataatgtaccatcggcccagccattggtgtgaacggagtgtaccaaaatgatatctccctggtccagagggagtgtaacagtcgacggagagacattgccggccgggtggaaaggatagaatgcgcgcagatagttgtgaaagacaggtcttggggcctcgggttgatccatgtttgtgtcctgggtgtcttttggtgttaacggaggggtcatctctgatgagccccaggcggaatagaatcgactcggtatagatttagtgtcgttgctcgactcggataaattcgaattggatttcgagatctttaacggggggatgtgtggcttcattgattccatctcttgtccgttccgtgactgagtaatttcttctccaagccgctgaggtcactgaccgaaggcgtttactcggtaggtgcaatggacatggttcagtgaatccaactaaaaaaaaagaccagtatcgaaggcaagtggcgttggataatcaaggatggaggggaggtatcggatcgccagaggctggtgttgatcctacacaatctaggtcaattggcgctcaaggatatagagtatagggattgaatgtttggaaatgccccaaggaggttgagggcttggaatgccaggagaggggaaggatttaggaactttgaactggacatacaaacacagaaaacaatattaacaggtaatcaaaaactataaacagatccaagcagacttcctttccaggagtccggaatattcaaggtcccggagggatgagtcgtaatgaggtcaagccaatatcaagggatgaatgacccaatgggtaacttaggtaaataatgcaaatgcctatgaaggagaattgaggcaagtgcaattgaaccttggaaggaccgcagcaaggactgtaaatgacgaaagagggattccctattaaggtaacgcaagggcggaagggatataaaagaatgctaagtataagtataactcgcaattgccaccggcagcaatacaaaagtgaggaagaagagcaagaagagcaagaagagcaagaagagctttgaagtaaaaggggagaaagggaaaaagagggaattaagtggaataatagctctggagagttcgaaagggccatcttctgggactcgatcgggacgatccacgctccactggtactgggcctgtatggagatgtaatgtactccgatataatgtgacgggtatcatacaaaagtacgtatttataaattctttcctttttatttttgggtttttttcactttatattttctttttttaaatttcagactttatacgtttaactcttccaaactgctggctctctttctatctcttattccagatttaaagatggagatctccaaaaggcagtagaaaaagaaagaaaaaaaattgaaatcggaaatttgaggaatccctcctttcccagatttggcctgtctatgattttactctgaataccgtagaccctcggcaccctccactggtacaaatgtacaaatgcagaatgtacctcctacacaataactaggctaaaaggtacatctctcatatgtaccaagtctagtctagcactgtccaccttacatctgccgaacttaggtaggtacctaggtactcagagtactctgttccagacctcccactattccccctccaaacgcaataaatcctccattttaatttgtttacaattgaaagtttctcccgcctgggaccaatcatattgccacagcgacataaatcttgtggggttaagtcaggccatgtcttaatgcattgaccgtgtgctagagcctgcagggggactcgatcaatcattaaaactgagggaaggggatcttctggtcgcctgtcaccaatatctttccgggatgggatcgacagcgcagcgaccgggccccaaagtgacagcagccaaaagtctttttctcctagccgttatggtttattttcaccaggttgcaaatattatatccctccgtaatccgtacctcacataagaaaatctcaaatctcaaatccctgccccttgtccagaccccggtctctattgacatccggaccaagctgtatgaacggagtaccatactgagatccccctccatcttttctttttcccctcccgcgtggggcgataaccacaggaacaggttcgcaattggcaaacaggatccacaaacgcgagctgtggcgagttgcgaaaaagtcgaacactgtcgcaaagctacccgatgcttgcctatgttgtagtgaggcatacttaatcctagctaattccaagctatgtgaagccacggggaaattcatgacgcggacccgctcttgtctaagacctggaataataatagatgcgaggatacgggaggaccttgccgcatgaaaatttttgatgtacttttgttgactaacaatagaatgtgcattgcccctcgacccagaatgaactttggaatattcttctgtgaatactttgatgtggcacacattaatgttatttgaccaacacgttccaatgattctttttaaaataattggacagaaatactcgatattcaatcatgggtcagggtcgaaagtcgcaaaattgaataatgacaatatagaggcgaatttcgccctcccatggtctaggcttggagtaattggagatactaagtatggaacttgtaatacactatgacaatgacatccatacgctattctattccccctttccccatcacagcgtcgcacgtcctcccgcagctcgaccaacggattcgcagagctaagtgaacttggtgattctgcagtcgccagtcaacattgaaatgtgcaaaacgcatacttatttctcctaagcacgcattggtcacacgtcacatgttctggagtctttgcctccttggggaagtatagaattgctagttcctgataactaatgtttgactaatgtaagtcagcaaaaagctatcaagccgagccaactagagcgagtgagcagtgtcggcacaaacaaaaataataaaaaaaggtccgaacccgcccctcgtggggtccaatcgatggctgccatagtagtgcaatgcaagccccctccatatcatcacatcagggcaatcgcagaaggcgatctgcgggccataccttcaatgggtggaatgtccgtgccggaggcgggttcgaaccatgggacggaggtgcttagaccaagtctcatatctctgatgtcgacgtgctttttacggtcgcgtatatagatcgcgtagaatattgaggcttctcaaatgtacacccagtttggatatagtcttgttttgaacttattgtctctcgaactctctaaagtaaaaatacagtgaaaaaaaaaaaaaaagtcgcacaatgcaacttatagactgatacaattgacgggtcagcccgcgtctcacactgtttgcttgtctcatctcgatattacctacagcacagatcaattacccctacatatgtatgtgctttattagtttaacttgctagttagtttgctgtttgtttacctaggtaactttgtacattttcgtcagcaagctgcaaagcacacgagcacatcacatcccggcagactcgtgcccaagtagtggggcatgcacggtcgttctcccaaagtactttgtactaactagtatatatccattgtgctactgtgatgcaggacccgtctagttgacaagagatcatcggggaaagtggtatcgttacatatatctgatctgtttaacatgttcaccgaggtcaagaagcccgacccgcatccaggcaaccattttaggtaggagcctacctaggtcgaagcttggggccagtctggatcaggaatggtttctgtgataagacacatgttatgtctctgcttattgtcagtcgtatttttgttgctgtgaatgattatccttcgggtgatattttgttgggctctaaggtgtgtagggacccaggaagcagagagagagagttgtgttgggagagaaaggagcgagctcccatacaaactatctagttcagactacgaacgaggggttgatgccttgaaaccaagccgtccaacacaacatatttccagccgaggatatctctccgagtgcgacgtgatctgtcttctcgtgctcctcgcgtataggaaatgaacggctcaatggcagggttaatcagcaagacgctaatctttggatttaatgctcatctcatactgtatattagttagctttgtggggccaattgccgaggcaagaccagggaagcgtgctagatacctgagtcgatgtcttggaatatcaacgttggcatccgagagtcagtggaacgtgccaaatagcgaggtatatgctatgcggtcagagtggtgggcggggacctacatgtaactattgtatggacagagcctctattggatgtaagcggtatggagagtagcttacttgtaagatctctcctgtcttatcgatatatattcatgaacacatggtaacagccgcttaaaaaaggttgtatattggaccacaacctagttgcgtatggctcagcaacatggaagacatatatccatgcaatatatcatcaggatcctctggtaggaagtcccatgaccaacacgtgggcatgcattcagacaatccgaattctagctgttgagacaagtcttcaagtttatgttgtgtcacctcgtggcattaattgttgagatgcggtgagcggctgaggctgaaataacactgcagttttatgcataggtagtgcatgtacctgcattcgactgcaagatcgcgctccaaaccttgggattttggttatgatctcaataaagtcggtctttgcatcttacgtgattcgatatgcagagagcgctagcattcattttctctaaagttcataactatgctttctcaccgagttttccaacgttctattgatggctgagagcgcgcccgtttcttcgtggcctttaccccacgatcgcgatcctgtaatcacgctgttacgcaaactactagatgtgacccttggtagaacattggtccaaatcatacttaaagcatattctaacatcataccccagcgtgtattatatgttgtgcattgtcgactaagtctacaccccttcttcttcatatatatatatccggtttaagcttttgctaaagacgatgtcgatcagctatattacatcaacttaaaaataccccgtaacaacgcgaccactgaatttcgacattgaatttaacacaagatcccatggatgcgtacggaaccttggtgcctgcctaggtggtcacagggattatccatgcatacataagtttatcgtggataatattgacaagcagttcaaataaaaacaagcatgcagcgtactccatacacataatccaagctcatcaatagaagcagcggaatggcggtggactcagaacaggggttatccattcaacgtccacggagtatactccttactttgtaaagtcctctacagttgtacggatattcataagcagtccaaaaagcagatgcacaaccctggaaatctagatcgttctcaaaatcttggattcgaaagatcaggctagcagttacagggtctagttagcgggagaaagtacccaaaaaatgcgtacatgataccggaccttgtatagtgatttgctagatggtaatggtcaatgttacatacagcgtaagtttccatattgtcgattcaataccaaagcccacttagacccgcgcatgaaagaaacgacccagggatagtcgccgatggggcgatatggaggcaatcaacaaagaaagatagaagctacgcatacatctccactcaccatactccacagttcatttcgccttaaggggaagtccacaaggaaagaaatcctctaaaccctaaaatatccgggacggcctccgcagctgtctagaaagccaccagaaggtgacaccggatgcacacggctggcggattggctagcaggattccgcgcaacggtccagaccggtacttctttccgggattaggggctagtctgcgcctctttccctaatttcatatccccgacgccaccaacagattatacatgatagcttatgttacctgtcaagcactccagggctcggggccaccaaatgagcggcacagtgaagcgtcggctgtataacctctgtccgagatgggtataaaccggggttgggccgccacacgcgatgcatttctttgttaccactttgtccacgatctgagatgctagattaggaccggcgataatcgggcccagagagtccagattcgatcaggcagatgagctttgcccgaaattggatcgcagccttttgtccccttgctttttagcatggcgaaggaacttttgtgcgggagagcttccggtcccaagaacaaagactcgggttgccttagtggaggctcgcagtcaggggctgcctcgaggatttaccatgcgtcttcgcgtggagcttgatgcaccatgtggtcgtaaatccactttatggagtataactgaccattcattggcggtattaattaattgaaaaccctgagctcgataggtccatcatgttttgctctaaaatcaatagtttaacgtccccttaaagtgtggatagaggggcggctgtgccgcagttccagagttttggtacggagtagagttcgaggtcagaacctactcgtctctggagacttgaatgtcaaccttgcttcgggcaatgcaactcaaagaatcgttgggatctccagctgttcgatttctttgtttggcgctgcacgtgattgaattgcaatgcgggacttaacagcaatccccctgtcaactgggacagacctggccgttgcgcagtgagcaggggtttgagagcgtgtgggggaggctagaaaactagcggccctatcggaaagaccgcgtcactccgtacggagcagactattgataactttgtgtcgcgtgcgttcaggccgttgaggggatcaatagtttcactgaaatgattactattgtaaggtgctgaccatgaacctggactccccacattcacgccatttccttggggcgggatgaaagaggggatatgataggtattggattgaacgtatcattatcagaatagtgcaggacggcacggttaaagggatcaccgtcgcgtccgcgctggtgatgtgatagaggcgtcttgtcgcatttacgagggatagtttaatacgaagtacagactaaccgtacagtcgtagtgtgagtcaataatagactatcgaccctgtaatccaactgttgagattgcaggagacctcgggaataaaaaaagcatgtgcctggggtgtgtctgtgtcacgtggaccagcacaccttctaggcaggcacaatttccaatccgatccctcttcctttggcttcagttaatctattaagcaccttggaatggcgatctcattttagaaaaccccatgaggtgaaacaacctccacattgttggcgatcgcatcaactccactgtttccgacatacccagagttctactccgtactccgaagtcttctctatacatagccttacctggcgcaactcatggacagttatggttactgcgtcattctgtggggataaccttggaagggcttgaagcttccctacaacattgtaggcaagccgaaaagccgaaccggttactttgtggtttcgacggcaacccttttttaattcgctttctcctaaactcagatacacaaggaatcctcaacagtgttcgtcgttggttgttctagcaacggtcccatttagccggaaatggaatattctctggagtcaactatttactccagtggaccactgcatcgggaatcaagtggtctagtttaaagcccggtatctactccgtacggaccacacagaagtgctcacggcggagctttggcttttggttctaatgagaaccaagaaacacgcctttttcactccactatcactgctgatctttgcttaactggattacgtgacggaatagacgcgggaaacaaggaccgtttctctgtgaaatcgggaacgaagaacatgccctcaattccctgagactatgacaacatacccgtggactcttatcttgtttaacaagctcggacttacggattactccccatctttcaatggctctccccgcttagggccaggtttctatgaaaggagatttgccgagcgatcagcaaccttggaatccttcctgggcaaatacggtaataccagtattttgtgtgagatgtgataagaaaccccagcctctgccaaccaaatcttcgaagaaacgagaaatagaaaaggggaagcaaaaattttccttttttttcatttttttttttcaaaaacccaaaaaccattaaatttcaccagagtttctgcagaccagctcgtgcgcagatcccgagttcttcacagcgccgaatcggattctgtcactgtggagagttcccacccacgtgcatctcgtcggagaatgtgggatttattccgatttcgcggtttccgcgggaagattgggggtaagctactccatactccgtactcgatggaattcaactatgacaggaggttccatgttgtcggtgtaagcttgcaagcgttagctaatgatcggtgatattctaggaaagcaaatggtcccgttctccaaggctggcccacgatgctgggtcgaccccatcatttccactcgagagatccctttcgcttgtggagatagtccatcggtgtaagattcctttgtattttgggtttacctttccactacctgatcgggaaggtgaaatatgtgtcacacttctagccccggataatgtctccagtgcacaaatggatacatccccacgcgccagctcgttggccctagtgtcgatgcaatttcatcacattgtggagacaggtagggctcaggaagtatggagtacggagtacggagtacatgttccaatatgggcggctaactcggagaaatggaatacgggttggttgtagtatacgtcgatgtgactactcagcgaatatatatacgtcgtatggctttactcacttccttttagactcgtggttatttcaattacatagagtcatgtgcataaacactgtaacttgatcacgtagaggctcttgtataaaggtccgagaatgtacaatctatattctatgctctatgttctaaaatctatatgctacctagtaacattaacatgtacagtgacggtgcataagtttggacaccccctatagtgggtcaccctcaccgccctccctaccgcctatcctaacacgccctaacacgctagtatagctagtatgatctcgcgtctctacgcggttttaccccctacacctcccattttcactatggctccgcgtagtgagcttaccccagcactacgagagcgaatctgtgagcttcatagcgctgctgggtgggggtataaacgaattcagaagcgatatcctttcatttctatctctggggttcgttataccattaaacgcgatcgtgagagaatcggcggtgtcacgaagccccgtactggacgccctaggaagctggacgaagctgatcgtgagaaactgcttgatactatcgctaagaacccgaaaatcactcgtgaggatatgcttgctaaggtatcgtataaagttagtataacactactttatgctattatatactcctttctaaccttttatataggttaaatatgactcaattcgacgccttttaaatgctaagaatatacggaagtggcgttgctcttggcggccttacttaaccgaagctcacgcggttaaacgtctacaatgggctctgaagtatcgtcactttacacctaaggattggggccgagtctattggtctaatgagtgctctattgaacgtggtattggtgttaagtaagaatagacttttatacgcccgcgggaccagcctcggtaggggcaatgtcaaggcttaccctataagggtaagcaagtgaagcagatgttttagggtgctttttgtggtgatttccggcgaactggtttaattcccctttttggagacgcttaatctaagagggggggtattaaccgctttgttattaaagagttatatcgtcgaatcctacctacattgattgtgcacgaggatagcatttttcagtatgataatgcgccttcgcacactgcaatcattgttagggaggctctagatgagatgcaaatcgaggttatagattggccacctatatctccagatttaaacccgatcgagaacctttggtcgttgttaaagcagaagatatatgagctccgacctgagctgattcatatgcgtaataccgatgaaacaaaggacctgctaatcgctactgcgcaagaagcatggaatctgctggattggaagcatatagagaacctatctgctacaatgccgcatcgggtggaagctatcattgaaagtcagggctggtatacaccgtactaggtagatgtcaatggaaatccggaggttttggaccggcagaatattacataatattagtgggtggggtaggggggtgtccaaacttatgcaccgtcactgtatgcaggggagggaaaagttctcgatgacagaaaacgcagaaatgcgcggtgtagggcttcatgcgtgaaaggccgcgaagtgagtgtatgttgtataacaggttaacaagaaataaccagagaatggcaaaagaaagatcggagaaggaaaaggctcaatcaatgagcattccgaagaaatgaagggcttggagaaaaatgatgaaacgatcaacctactcggccttcttggaagccttggttctcaacttcatgagtccaaataccaaggcatatccactgatggcgaagatgaccgagataccgatatctctccatccggtggtgtagttcatgatattgagatttctcaggaaatcacttccgtctgtatactggcagaccttgcaggccgaggtagcatcggggttgaccaaattgatgcttgagccagcgccggacatataatccgacaggtactgcgcgcaggtggtgccgttgagcggctcgaacaaagcaaattcatcttcattgcaggtaaccttggcaccccagaggccgaaggtcaacatacccgagacaacgtagttgaagggattgaggtagtacatccagtaccgccagaacacgttgagctggatgtatgggacgaaaataccgcagaacaggacaagagtactgatgatcaaggggttgacaagcgcagcaaaggtcgggttaggtgaataggcggcgacgaattgaccaataccagtgtaaatgagctcgtagatcaacatcatgaagaatgtggcaccagatcggctcgactcatgaggcagtctccagacggggtagtaccagcagacaaagtagagaaccgcacagatgcagagatacgggaactcggagacaatcaatccggtaacgaaggcaacccaggagtacatcttcgacttcttctcgcgagtatcgtagatatcgcggcgctggatgaagagcggttgaagctggttgatgacaccgggagcgacgaagacaaagttgaagatcgtgaacatcttcaggttcaaagctgacacacttgggccaggacgccagaaagagaacccattgagcatggctgagataatgtgaagggagaacttgttgttgacatagttggtgtttcggaaaagcgcgacattcatccgatgagtgacgattttggtctgctcccaaagaggcatggagaattcgaatccatcatcgacagttccggggggcttgctagcagcatccgcaatcattcggtccagttccgcgatcatgcgagtctgctcaggagagtcgagccatatctgatgccagtccttgtccttgacagattcgataccaccggtaacaacgtcaatcataaattcagctgcgttagcatcggtagggcactgggccccatattggccaaagtattgcttaacgcaggccgcattatcgccaatgtcgccaaagtagacagtctttccgccctttgcaagaagaaggagagtgtcgaattgagcaaagagctgcgccgaaggctggtgaatcgtaacctagaatgtcacttgtcagcaaaatggtcttgtagttgttgaattggagaaatagaagacctaccaaaacagcttgaccaacatcagccaatttgcgaaggaaacgaacggtgttataggccgattgtccatccaaaccagaggtgggctcgtccaagaagatcagaatgctaggcttggataccagttccacgccaattgtgacacgctttctttgctcaacgctaagtccattcccaatagtaccgataagagtgtctgccaggtcatcgagctcgagaagatcaatgatggtgtcgacatacttgagcttatctgctttaggggtgttgcgagactggcgaagaagggcagagaattctaatgcttctctcacggttgcgtatggctcgtgaacatctagttgttcgcagtatcccgccatcctctggaaagacactgggagctcacggccatcaaccatgatagagccgttgatagtaccatctgtcttacgctgagcaagcacatcaagaagtgttgtctttcccgcaccagaggagcccataagggcgcctagcatgccgggcttgacccatccgtgaatgttatccaacagcactcggtcgcccgtgggggtttggactgtatacgtgaggttcttccaggtaaatatcgatgtgtttcggttgagattttcatcgtcaacctgaatgggctcgtcgggagtctcgcgcgtagtagacttttcgttattttgtgcttcttcgtcggagacggcggcatgatgctgcttgagcttctcgcggggaataagaagagaagagccagcgccagcacccgctttccagtaggatgtgaaaacaattgtcaggatggcgaagaatccccaccagccccagacgacaccgaagttccgccacatttgagagtgcttgtagtgaagtgatccaaggtactgatcgccggtcacatagtttgcgcctggcaaagcaccaccaacacccgcacaagcttggttctcggctccgacttcctcgtagccagggccacttgggatcaggttgttaccaacacaagggatatggcgcccatggaactcgttcgacatggcagcttggaaggcataggcaaaggggttcgtgtagtacagttcgaggaaccagttcttcatctggggcttgggaatcatgtaacctgcgtacatgacaatgcccttgactgcagttcccgagattttagacgcggcttcgaatgtactgaaagcggatccgataaatctgaaaagagcggtgatgcactgaaagatgtaagagttagtccaagtcgacaacctgtcagaatcgaataagaaaacgactacttaccagagtcgttgtgaacaaaataatccagaaggtaaagaaagcagccgcagtatgtttcaagccagacatccaatagatgacaaccgagaagatagtgcactggaacaacagcaccgggaaatccgccatgatctgagccaaggaaaacgcagccgggtggtacatagcaaagcccttgtgtttgaccaagaccggacggcccttaaaggattcagtgacctcagacatggcaacgatgcagttgtacaaaagcgagaagaatacagcgccacccttggtgaagagacctgcggaagtgtctggcgagtcgtagaagcaagaaccagcgatcaacgccatcacacatgacagaacctgtttgatgatgaatgttgacttctcaccccacagaatctgatactgtcgcttggtgcatgcaatgagctgaacccaaaagctggtggtcagactactacccttaggcaggtggctggacttttcccacgcaacagactctttgaaggcatctgtgcgttcgcggctgaggttggagtcgggatagtcatatgttgagaccatacggtcataaatgctggactttttgtattcggccaaaatggcatcggcgtttctggggaatgtgttttcgtatccgggtctgattttccgctctgtcgggactgtcacaccggtgaggaagtcgcctatggttttgttagttgatactaggcttggttgtcagatgtaggaaatacgtaccgatgtttgctccatcagtgtacacgaagcctaggtcttccatgaaaggcttagctgcagccgcaggaccatagtagatctgctttccctcgtcaaggacaaggaccttgtcgaagagattataaattccatttcccgcttgatatagggtcacaatggtggaaaggccgagaacatcagtcatagcgcgaagtgccttagcccattccaatgcggtactggcatccaaaccacgggtactgttatcccaggagtaaacagaacccctagtcgccagacactcgataatagagactcgcttccgctcaccacccgatacaccacggacaaactcatttccaaccttggtatctgccgtatggctgattcccatagactccagaagaaactgtttggtctccgctgtgtattcgtcaacactttggactccctccggtagatggaaaggaaccttgagtctggccgcaaagtccatggtctggcctactgtcaaacgtggatagaagagctcttcttctgtgttcatcacaatctggccattatagtcctcagcttccttgggggacatgcttccgaaacgtacgtcaccattcacggtgtgataaccttcgcggcgatttgacagcatcttgagcaacgtggtgcaccccgaaccagggcggcccaacacaagcaacatttctccgggcttgacacatccatgactgtctgacaagattgacttgagtggtggctttcggcgaaaatccttaatcaattgaggaaggttaaattgcgagatcatgttttcgttgacggcggcttcggcagcaaggacatcgacggttaaactttgccatgtaacacctagctcgcgcttcttgaatccagcagcttcgtcacgttctgcattccggatcacttgcggtgtcatgctccattccgcagtcttcttggggggtattgaagtgtcggcgtgagcgacattcaaagtctcggaactctttgcttcgtggatgttggcctggggtacatgcagggtctccacgctagtaaaattatgagtgttgagcttatggatgggctggttgtccgggcttttgttatcattttcgtcttcgttctggtattcgctgtgcagcgatccatcatcgaggccgggatgctgctccatgataggagacttttgaaagagtggagattggtcaaagaagtaaagatatagaggcacaagttatttaacctgggaggtctagcatatttatcctataaaattctacaaaggggcaagtcattatatgtgccgactccagacccgaaggaataggagattggaaggctgatattgaatagccgttccctattggctaaacgaatttataccatgattctgttcattattgctgctaatgcagaggccgttgtttcacccctatgaatagatccaaaggagcctggaaaacccggcacagaggccgagttccatgacgaaacccacttttgggcaaatcttgggttgagcgaactgcaaatttccaggttgtccaaaggctgttcaacagctaagcattggaagccggagaattgtccggttcacccggcttctattgtgttttgacacttgagacatttagggctgacagtgacgttgcagatcactgtaaaaagtacgatggatgttatccgtggataatgcattagtaaccgattgttcctgcttcttattttgaagtggattgattactgtcaactgataatctctggtgatctatgtataacttctacgcgacgttcgtaggcggccaatctgaccagcatattaacgggttaatgtttacatatttctggataaagattagtgttctagattaagacccccggtcaaacccgaaatcccctaaaattgaactgtcaagacagtgagcaaattagcaatgccgaggcaccgaaaccgtgaagattccatgggctgataatcccgataaccgggttcccggggatcccgatctacccgagtcttaccaaattgaactctggcctggcgtcttcccaatcaggaaatatgtgccttgattcccaattaggaaatttgcgactgcttgcccggatccattgcgggtctgccagaatctggcgtgctgcataaaaaaagggccatacaaaagtccatagttgcaacttcactagctgtcgtgaagtgttggctgcctgcattggaattttgaagtttcgcagcgatatcgtgtccatcgttcatggtaatgggacactttgttctattggccctcgagatctttaacactcgagtgcattatctgaagaggcaggtagctgcgggagtgttgagaggtcgaacttgacatagcgacaggcaaattgctgtcgcccgttccaaagccaaccacctgaagtaaaccgattgagtgcgtcagggtcatgccttggatctacgataccctctcatagattttgggattgatggaagaaaggaaactgtcatgcgtgcatgatgggggttacggcaggaaagcgtgacccctagaattattcttaggaaggggcctcgggtgcccttcatatctagccctagagtgtttgagagtgagaacccgggaaggtgcgaagatgtatcattttgtcattaagcaacagcgtgttgtgactcgttatgtagtaatagctattataggtacgaagaaaggacttttcacgtgtggcactaaaaagacacgcgacgatacctactagaccctttttgcttcacggtactagaagctgcagaatccttactcatatataggtactagtcgggatgatacataacagcctggaaactctaggtcccggaattcatgttacacctcctcctagtagcaactatggaagtaaaagccgaccacaacatccttcgaacttaatagtgctacggggaggcaaatttcacctgactacatacctgactacctgacggcctttccgctgtatctcatatgctaggaacacgtccacggattgctcaggtgtgatctgtgatcctaccgtttgccatacaataactgccaccactaatcatataatttgcgtgtcgcaaattacatatacaaacctcaacatcccaatttctagacgcgtcgtcgcgtacctaaaatccctgacgctgaagccaaactttctcacgagaaggttcaagccaccggaatgaggtagctccgtgtttttaagtcctctggtatgggtcttagctcttggctaagaacagcagtgggggatgtagataagaagggcctgtctggcacgcgttggaagcgatctctctctcttttctaatatatccgaaaaatcctctaaccaatatacctgacaaggcataatagtaagtgaccccttcagatacgcaccgagattgttagtgctattatgtggactcggtcactgatgtactataggttacatgtatatatatcctcaggaaccaacgacaccagtctaagccgatccaagaagccggcacaacatgaaactctcggtcattgccaccctctgcttctccgctttggtagcagcgaccccaatcccactcagcaacagagacttcctcccgaccccaatgcaagccgtggagaaactgttccctaactcggggatcccaaagctggcagagggaattgggaaaatattggagatttgtacgtacatggttttgcatcgtgttgaccaaaatgctaatgatatatcctgttgtttctagaactgggcggtgatgtctttcttgggtataggattgaatatgccagggggctatggggttgacgctacttttttcttttctttgcttgtgggttgtgcagcaagtctgccatgaaccgtttacgctggttccatacgatacatatatccatttataatactgcaggagtgtcgtccaaatgaaacatatcgtttaccaaaacatagattggacacctgagtccatagataccaaagataaaccatcacaccaactaaaacatgccctccatatccaaatcgaggaactcaggattgccaaccgccatatcggccgcattaagcacatcatcaatagcatccatgccagccccagaatcaagccccatatcctgacccacaccaataccaccatccatgccagcagccgccgcatccgccgccgccttatccaacatctggttgatattatccggatcatcctcattgaccgtattacgcgcgacatcagcagcagaaggctcaagatccatccgatcctcctgcccctcaacaccaagatgcatattctgaataatattcgagacatcgatattcgagacctgcgacggcggcgccatgagcatattaacccggcgcgaaagtcgaaccacgacctccgcgcgcagcgggtcactctcagagatcttaggcacgttctcgtgctgcagcgccaaggcatcgcgcagcgtcaggatcgcgcaccgcggcaaaggttccttgctcgggtcgactgggtggtagttgttttggtcgacggcgaaggactccgtcatcggtgcacataccattgtcgtcgcgatgtccagtgcgatatgtccactgcctgcttcggtctgctgcttgacttcgtcgattatcgcgctaagcacgcgtgttgcccccaacatgcggattcctgctagcacctgccggtgcgtgtatgcgtgtggggccatgctgattcctgggttggcgctccagaggacgagggattggagagttgcgcgaatgctggctattagcccgcctgtcgggtgggaggtccaggtgtcgagttcggagcggcggcagctgccgacgcggcggaaggagatgtatggctccaaggcatcaaggattggtttgatatctgtgcgcgacgtgtttcttgttcggacgttttttagttgttcttctaatgggcatccggttatgttcaagactgtttgatggatggcttgagcctcgccggagattgagctgggtttgactagggagtggagggttttgatggggattgtggggtcggtcttgtcggtctctgattcccagatgtggttgcccagccatgttaatgcgacgactagggaagggaggaggaacggctcgagcaaatctgtattgtggttagctgggtatctaatggaaagcgaccgcgtgacgatgttcttacattcaaacccgcctttcaaagtgtcgaaatccagcttcccggactcacatgcaccaagactctgatcgaaaagtgttgttacaagcatgtaaaattcgtgtgggctgcaagtggacatggtctcttcgctgatcccctcggcaatgaacagagctcctatccaagcgccgagatctttgttttgcttctcgctcaagtcgctcagcttctggctgcaagcgccccggtccaaaagcttcaacaagaacgagtcgttgctcgagatacccatatcagaaggactcaagtcatagcggtatttgaacgcgagaacaagcaacaagatactgccaaattcatcatagacaggctgattttcgccctggtcctcgtcccacttccaggaatccaggacagcacaaagaggttgcaatacttgctttgtagttcggaaaagcaacatgacgtccaaggtctgcgggcggcgtgagagcgagttgcagatgttcttgagcgtcattgtctccttctgattacacaaattatgcatgaccttgaaaaaattagcatcctaatgctttcagaaaacacacatcagtagtatgaaacatacctcgaccacggcgccaactatcgcgcctgcattaccctccatcgactcgatctcaccaataagctgctcggcgcgttcatgattgttattgatttgcgaaacgagatcgtccttgacataaggccccccactagacagtgtctgcatggggttttctccgagaagctgctcaatgctagattctcgtatgagcttatgcgaggcacaagcaaagaggaactcctgacgagcatctgataaaacactgctgccctgcatggagaacatctgagagaaggaggggaatgcgttcggatccaaacggcttaaggcgtggctgatacacatttccattgagatcggcaccatggatgctgctgagatggccgcgaaaaaggcgggaagcttgttaacaaggaaagatcggaacaaaagcattgtgcggctagactcattgcgatatactccattggaaagaacatcgaaggctgctgtgataatttcctcgatgaggacgtcattgtggccctggtaaggggttagttacatgttctgagatgctctttactagtgatggaaagactctgaaccactctgactagtgagaaagaaatggatcgtattgattagacttacctgatatcgattagtgaggtagttgatcagaatggtatcatcgaccagaggacgtccgacaacctgttgctagtcagtcacgaacccaacatcgcagtgtagagaagcgtaccattgaatttatgtatacatagagtccagctctagtgttaacaactggggcgtccatgacagaagactcaagctggagggcatttacattcacgccgtcaataccaggcccctccaaagtcttagaaggctgaccaggataaagatggaacactttctgcaactcttcgaggcgatgtcgaagcggcagagagacatcgatacaaagaggcagataacttgacaaagcctgtcccaatttcgttttcaaccctagcggaaatcgttaatagaccctcaacggatatggtagtatcatctccaagcggagaccatgtagatttaccttgattataatcgctggacagcacttccagtcctttgctagtcccagacaaagccgcaagtagaatcccaagcgactcaaacaacgagaccgcgtcaggtgaccccatcaagccacctgtgtgttgcgaggcgcccatgctgttattgtgccacgccacgacagccagaatccaatctacggtagcagagtaaatatctgcagcctcgatcacggtcttgggaattgagccggtggaaataaacaccatgacatcctggatgactttgatatccgtcatgagagtggatggtttctgcttcttggacttaggcggcgagctctgtccctcgccctcgccctcgccagatcccgacccatccagaacagaagaatgcttcaaaagactcgccagcgcagatgaagacttgaccctcccaaccttgcacagtccatcgacgtacaatggcaaaagagggtcccaggtaacactggaggaagcgcgcgcttcaaggagcagatcgaggagctcattttccttcaccggcgaacgggaaaacatcagccctgacaagtccgtgaactcgtctatatctatacgattggccaaacattggtggaggaaggtcctccattgttcggggattgccctgtccggcagcattgtcatctccacaacataacactgcaccccagaagctagatatgagattgcaagttatagactcgcaataagcatttttccttagaggaatagatcgctggtcttgaggctgtgagggatagctctttctcaggtcgcgctccgggctcgtgaaagcaattacgtaattatcacgtgaaacaatatctcaatgcaccacgtgacttgaaatatttctaatgcctcaggccacgattcaatagtcacggacattcttccaaggtttgttgtacaagcattatttaaagtcatgatgacagagacaacacccgagtggacctatgtatctaatattggacttacttggataggattcaacgagagttatggcattgacattcagtcctcggcgactctgataagaatctagagtttacaactttacgagaccacacaattatttttaagttattcattgtatctcattatcatcatgacagtcccaagtgcagaaccaaaacaaacagcggtgctcaagtggggatatcaatcgaatgcaacagtggagaaaaccaagcgcctctatccgtaacccgcttgacaaaaagggtaaaaagctatttaaatgaaaagaaaatgcatcaaagctgcctctccttaagagaggacagaaatcgtcacagaacacctcccagaataaatggggatgcgactaatttaccaccagtcaccgtgctccttcatggcctcagcgaccttggtgaaaccagcaatgttggagccagccacgagggaaggaagaacaccctcagcaggggtgacatactccttagcagtagagagaccgttgttgaagcagtcctccataatcttcttaagacgggagtcaacctcctcacgggaccagttgacacgggcagagttctgggccatctcgagaccagagacggcaacaccaccagcgttggcggccttaccaggggcgtaccagatggcagcggcaccagggttggcatcacggtgggcctcgaagacatcgatagcctcctgggtggaacccatgttggagccctcagcgatgaacttgcagccagcggcgatgagagccttggcctcatcgccggagacctcgttctgggtggcggaggggagagcgacatcgatgcggccggcgatgttggtccaggggcgggcaccggggatgtacttgaacttggagctgaaggcgtcctgggtagcgagctcggcgatctgcttgcgctggaccttgatctcagcgatggtgttgatctcctcagcggtgaaggagccctcctcgccgttcaggacgagagcaccctgggagtcggagagggagatgacggagccaccgagctcgatgaccttgagagcggcgtactgggcgacgtttccggaaccggagatggcgacgcgcttaccagcgaaggattccttgccgccggaggcgtgctggatcatgtgctcgacgtagtagacgacaccgtagccggtggcctcggggcggatgagggaaccaccccagctgccacccttaccggtgaggacaccctcccactggttgcggatcttcttgtactggccgaacatgaaaccaacctcgcggccggtcacaccgatatcaccggcgggaacatcggtgtcggcaccgatgtgcttgcacagctcggtcatgaaggagacacagaagcggcggatctcgttatcggtcttgcccttggggtcgaagtcggatccacccttaccaccgcccatgttcaggccggtgagggcattcttgaagatctgctcgaaaccgaggaacttgaggatggaaaggttcaccgtggggtggaaccggaggccacccttgtaggggccaagagcggagttgaactggacacggtatccacggttgatttggacctgaacggaattagcatgtggcaattaattagacattttcaaaaagaaaggtcttacctggcctttgtcatcttcccagacaacacggaactgaataacacgctcggggacagagacgacctgaagagccttgcggtactcgggcttcttctggaaaagagtggagttctcgagagtggaggcgagctctgtttcgggattgttagctgagtcaccccgaaattatgcccccggtggagccaaaggccgggaagatgccgatgggtaaaggaattgagtcgggaaatagtgtgtgatatggacgatatggaattgaaataagaaagggaaaaattaaaagagacatacccttgtaggcctgctcgaactcaggctcgaagggaaggttttgcatcatttcggccggtactgttaactctgcttttaggtaagtagatcaatgctaagcagtgatctaataaattataaataaagacaagagcagagagagtattaagacaattgagattcaagagagtagatgagaagagaagaaaagaatgggatgggggagtgtacaattatatagagatgtggagagagagagagtcgaagccggagtcggacgagagaatccgggattgattggagggaagacgggagatgggttaatgcgcctacaagtcgacaataatccccaagaccaggttgcacggggaattaggataaagatccaagagaatcgatgaaacccaatgatttgcctttccgtgggaagaacgtccgaagttcggggcccgaacaatgttatcttatggtttaaggtcacagaatttgcacagaatttggcttatctctcccactccttttggtcccatcaccttcattactacactttaaccttcccatcaatcacagctcgtttttttatccctaaatcttccttgtccctaatatcccttccgtgttcaattcgtgtccttcggatcggtcctctccgacaatcttctgaataaataaaatgttaaaaagtaaatttaacctacctaggtagtttattaggaggctgagagaaaccttactctaagtaaagaattcgaaccccagaaaatgcatgatgcgacgagttggtgcttgtactatgatcgacctattatgaagtagtatcctataaagttggatggaatcaaccaaaataggaaaaataggaaaactaaaatcgaaataaacgaaataaacgcaaataaaatctcgagttctccgccaccaactgccaacttcggcaatttgactcggctgcaggctctgtcacgtgcccactatcccataaacggcgatcaaaaaatggatcctgctacttttggcccaccgagcttatctgatcgtctttttcattctctaacacgttttactcattcctcctttatctacagcgtttagtttaagcaattaatcacttcctttactccacggaattgcactgaggggtagaggggtagaggggtagaggggtatccccccagatgcaaatctagtcagaatgataaggggaaaaagaaaagaatccgtactacagaatgttcatagtcatagaaatccagaaatctgggatatccgaatacccgcagtgccacccagatcccgaatgtccagtcaattgccccctaatagtcatcccggtgggtgcaacccgatttcccagggcttgtcctttcccccggcttgggtcaggcaccaatcccgtgtgatgccaagacccggttaactgcattggatcatcccccgatagtcggcgttgccaagcacaggatactccggatatgagatgggatatgtagctcttagttgatccctaatcttatgatgaacatgatattgctgcagcattcatattgtcctccagtataatggtgcatcatacggtgttcactagaagaaaaagccaaattgcaacggatatcatgatgtttgggacattggtcgatcctcagcatcatgcgaccgcccagcaatctagtggttgcccgctgcagccctccgcagaacgccagaattcgggacgcacctccccactccttactgatagcgatttgcggaggccgcgcttggcttcctggggttgctgcatggatcttcaccgagaagccaaatgtagaaccaattctcacacgggccatgctccgtctttttcattttcccgacacctaatgtggtgtgatgtgtgatgtgtatacgtaactctttgcacatcaatgagtcgacatcctgactgatgaatcgtcggtgcacatgaccaccaacgcacacagatgtgggacaaggccccgtcaggacccagtgggtttcccttgcagatccagaagcttaattccttctagagctctctagcctccagcgctgtggactaaattcctggttcccgttagtccctaatgtctgcatatgcgttcttatctcggagattcggaacgttggatcttgggttcgacaacgtgcttgcatgaaaattgcaaacgtggacaccacgtcgtctagttcatcgggtagatctgctagattgcgagtagttcggcgtcttctttcatgttttgcgtactgcgccgtgatcatatgtacatgcagatagtgcttgggttcccgagtaaagcacattgacgttaacgtccttttgctcaggacttgccatgacgtgctatctaacggatgagaatcggtgtatatcacaaactcatcgtcttgacttatatagaaggtcagtttattctaataatttatatacatcgaactactccgtattacaggtacaatatacaacatgaactattctccactaagaacataatctccgaggcttggcctggtcgatccacacccttaaagcatggtccaccacgtattcgccattcagacaaagacgataagcctagaaatatactaactccagaggatctaacccacggctttgctaagagactatatatacggtggcgtttgccaaagcagcctaatatcagaccacaatctgacgacttcgataatgatctatatgcagataaccatcagcattccaaccaagccacgtggaaatagtaacgagcctcaattccacactagcctagcagcaacttgactcatccacacctgcccccagcgcgatgtccgaacccatcaaaacccatcctaatattggactattaccaccagaatatctgtactattatatacatttatctcgcacctaccacctacctataaaatataccagaccttcaaaaaaacatatatgcacatacctatgctattcaactatatccacttacccacaagtggatggtgaacgtccatttccccgggcgatcggatctcaggaaaacggcgtactccgcaacaaccgatcccgcacatcaaaagaatattaacaaccttccgattcgtccaaatttccctatcgaggataccgtgcgcccatgacacacaggtttacacaagatcatcggctagggcgctgcattcctgccgaccaagtgggatagtgatcgccagtgtcgcgctattcgcggggtagggatataagattgtacatattatgtaagagtggacaatggaggagagggttaaaataatgtgatggtcttcgctgtttgctattgattttcttttcgttacttgtgccggggttgggttatcatattgacctgcctaccgctacatggtgacacgtgtcggctttggggtgtgaatcgatagatcatgttcgacactgctcggatatataaatgctggtgatcttgctgcagggggtctagggttcaccgtttttcccttcttggcggaggattggtgtggtacctgtgcataggttcttcaccgcgacaaacgtgtgagggatgtgacgattgcacacggcgagttgcgatgtcaattgaggatattgcgatcgatgacaccgacaccgcgcctcctcgttgttatgggacctattgatcacaggaaaaattcgaccctcttgacatgacctgaatatggcggtcggcgggacatgtctgtgttctgcatactgtttgggcagtgatactgctggtgtcgacgaccaactggaccgaggctgcaacgctacagatacatcatactcgtatgatcttggtaatgaaccccggtcgccaactcgctggggagctttatccggacatccaccagctgcagtgtatagcacttgatcatgcgatggtgtcttggaatgacacggtatccatagcgaccggcttgtttcaaatgcatgctttataccaggcgcagggtacctagatatggtcattgggcagtactagcttggaattctccttaatttatctacccgctccgcaaccttccaggggtatccgcagattctagccaggattgagtacttgttatcgggttcgggtgtggcacacaagttcagaatactgcatcatccggtaggacccgactcatatggcatcggggatgtgtcataacggtccggattgttgcgtcggctccgatgcaagaaaagcaacgggttgtcatcactgcagattaaagtgctgcgttggggggtcttggggtcttcggtgcatatcatagactatcggtgagacccgggcaatgcatcatgatcggatttggcaagagccatgcgaggcagtcacgacctatcgagtttcgagtggcagtacttggtagttgccagagagtctattgcatcgatgcatccccagccgtcccttcttgatttattgaccacttcgttattctgactggttaacttggactgcaagagagacacaggtcatatacaacatatgtacggagtagctgtcaatttgaaaagggagtggacctggtgctccgcatgtggcgaattccacgggaataacggagaacagagaaacagaaaacatattgaacggaaggttcggattcatagaaaatattgaaattgttgtgagatgaatgaattaaactcgacccaattgaaatctccgacattacggagtataatcccaaagaacgaaaagaagtaataaaggggatgcgacacgcatagttcttttacttccccctagctcggcgccaccagattttgtgcagctgaaaggacccatatcgactccagaaaaggagtcggaaaaaaaaaattgcaccacacaaataccgagatcgaattcgtaatcggcattcaatatgatgcagactccatacggagtactccgtacagagatggtcattcctcctaacgatcagctctgtcatttctcatctgggcgcgatcgggtcagagcttgacctctccgttaaagggggctctcgactctcacagctcgatgagtggcccctgctctcccgtccgcgggtgctctggccctttttttaagtagatcctagctcgtgtgctctagtgacgccatatggggctgcctttgtttgtgtctcatggcccctgaaggaaatgggactgtttaagaagtacggaataggttcgaaatacatatatgtattaaaaatataaggaatcttagaataaaagatggagacaacaacagccgaagtgggttccgggtcttgtttgctgcacgcgatattgaagaacccggtttgtgggaacttggcagggggttacccgtgggcatagtagccaatatacagatcaacttgctgtgtttgacttagatatgtcaatccactataaaaacgtcaatcccaatgtaattcctgattcaattattgcgtaaaatgttggtgtccacgctacggattacactgcagggcacatggtccaatatatttaatactgtcccctgatcagtcatccactcaataagcagcgctgacaatggaacaggcagaagctctcgttgactacgaagtacctcccggtaatattccaatcatgactaggcgccttgcagcgagtaggccagcccgggcttagattggttgaatacaaactaggaagttccattcatgaagggacccccttttttttttcttcctttctgatccagtccagatccagtatgattatacgaagctatgtcatgaccagaaagccttttaccaaaaggagggtatcattaagatgtcatcttgatccgggccaataatacgtggaagacgtgcaagacatgctaagttgaatctgtaacaacaagccaagattaagattgatagtaaggatgtacctatgtactgaatttaaattgtaatatcagcgtaataatgtaaaataaaataaaacctcccccaaacccaaccttggaaccctggaaaagccctagatcgatatccacacgtcgacccgtggttaagcagatctcagactgattggcctgaccggatagacccgtcgatgtcgatggatccgattcaaaatcctccgtactccgtatacacgttgactttgggctcttattagtttctattctatggatgttccagaacaattttgatatttttttccctttctgattttacttcgatttctatcttccctttttctatttccctttctattcctctttctgtttctctttctctttctctttgcctctttggggaattggaactcacatgtatgtctacggttcttttacttcatacctagtatccccaatgggtattccatgaacatcccccccaaatctctcgtctggacatcctagatggtcccctaacagatgtccatcaacaagccccaatctcgtggtggactcgggaccatcagggatctgttccgatctgcaccgccctcccctacctccccttcacgacgtcgagtatctctcctagttcgtcgaggtagggatattttctccaagtaacaatccctccccccgtctgcctttcatcccaactacccctccagttcactcaattcggggccgcaattcgaccccactggtttcccagaacgcgggaaaaaaaagacgcacagccccgaacagaccagcgaaatgagaggacacaaactaaagaatgcatcgggcaaacaaatagacaagtagatcctccaagactacaaacctcaacctcaacctccacatcctattcacccacctcaccacaaccatccatgaactcccatccacaattcgacccggccaccatggtcggtctagccggtgcctccccaggaagatcagacgacaacttcgatatctttgaatggtacccccgctatcaaagctgtcaacgctacttcctagatcacgcccagcacagcgtccccgtccaggccctctccacattcttaaacatccgactccccttccagcgtcaaccgaatccaatcttcaactcaacaccatcctcgtcttcctcgtcttccagccaaaccccacccggcacacaaccccccacccccaccctccatctcattgatcccctacatccgccgcctagtcgcaacaggcatggacttcccaggcgtgctgcacggcttcttcggcgacgactggggcagcggcgtgggacccatgcacgagcaagaacgccgcaactacctcttcgccgccaagagcggcggctgggcctccgtgaaaaaggactacgacatcgccccgctggagaccatcccgttcctgcgtccgttgcagggagccgtcgaggccgagatcgaggccgccgagcgcagctggagtgaatggctcgctatggaggactggatggttggtccccgggcgccggatatcatgcacgactcatcgtcgcagaactcacggccgcgaagtgcgcgtggctgaagagattatttcgactcttgtcttttcacatcgggtcggcgacatggcgtccatcagagccctgttttggttttggttcttcacatctagcgatcttgtttgtttctttgcttctccagcggcgtcttcttttaccagcattaattggggatcctatgcattgggatatgggtgctggctttcgccgaacactccattggttacggacgacttgtgctacgagctgcatcatcgggggtttttcttctgttcgggttttgttagatcagatggatctatcgatatatgcatattgcatctatatacaccctcaatccatattaaaaaatcgcgagttcactctctttaacgagcgtcttttaacggaagtcaagtcatttgtggctacggaatgactccggagctaagatacaaagggaaccggaaattggggtaactcgccatcgagatgaaaggaaaataataataatgataataataataagtcaacaataagactcggcccctaaagccgctccgggtctagtagaacaatacgggaatacgagggtatattctatgcatacatatcattcttatgtctgcagagtacactccgtacaaacccaactcggccgaaagaaaaaaaaaggaaaaaagaaaagtaaagtaaaggccagtcagtaattgtaccaaatcaacagaatcggctttccaaaatatcgatgagccacacccccactggtttgcgcttctgtggactcttcagatccaatccgaggggctaccgccggtggctggcccttgggcatgtgcgtttggggggcgacttacttttccgatcgaaatatgggagaatcgggtaggagtccactttagtttacatgtatttttgatcgtattcttggacaagaatcactccaaatttacaacattagtgagatggtctgcactacggcatagtgtggaataaatccggaaagatggttctacacgacactgtaatctctcaaaatggacaactcttggcgaagtgatcatatgctagggtttccacaagtagatggctaaggattactccgtcgagactatcgttatatgtaagatcccgttatagccaatctcaaagccaaatcccttcttggaacaatcgcggatctactccggaaaccctatcgagagacttaatttacatattagccctattagatgagatttaattattaacaatagtgtggcgtagctgagactgggctttcagccgccttcttaggcttttaaccttctcataggcgttttagttggctttttagttcgatgctttctccgctagccttgccaccagcggaatcccctggtcttccgcggcctatgagtggcttcttttagaaaattctccgacatcacctttttttcggatcttgcgatcggcacggagactctggttttgcttttgagtttagttacaagtcgagtgtattatccctcgttgcagcctgactttaatttcccatttttgtaaaataaaattgataggaaaattgtaggaagccgactcgagattggcacatgaggagtatgagcctctagatgagagcctaatggttgccaccagttgtccatcgaggaaggtaagatccctgtgtttccgcccctttcctggggagatcctgggaccagccaggtctgaagaaaaagaagagactattagtaacatttacgggtgattttcgataaatatgtacatattttgaccaagaaaccgtctgaaatgtactctccggcaaactcaatccaatcaaggtttcagaatatggcaggcaaatttgggtaggataggcatgtatataggaactatcataacagggaggcaatcggttcctatttacagtattagaagaatatatattcaggccagcagccagctttggtcgtgagatttgtcggatatcattaagcagtgaaagcagaaatgaagccaagagagaacccgaagagtttctgctcaaaacgccatcgctgaaatgctgcgaaagtaaaaatgaaacaaaacgattgccgcccaaaagatgcacggagaaatacacgggatgtcacggggaatattgtcatcaaatcccaaaaagagaaagcgaaagggtatctaagggttcgcaagtgcggtgaggtatagaggcaaaaacaaagaggccaatagaacaagtcaagccgccaagcaatggtcatgaatcatcaattctgttggagaacttctgcctcgagccagaattgcgggaggaattcgaattgacacgcgagctagagctagaattagatttaggccttggaagatcaccagcaagcgagttttggtgaatctcctccggaagcaggagatccggtaggtggtctggattcgatgccagactgcgtggacgtgaaagcacaccacccagagaaggattatccttttcgcgatgcatggtgtcgactggagcacgacttcggcggcgatatcggcggagatactcgtttgaaacagggtcgacttgctttttaacggctgctacagtgttaaggtagacggggaagatggcgccggcggagaagagcgcgactataacgcagaaagaatatgattcgtcgtgtgcgaggtatgccgcgtactcggcaaacgggaaaaaggtgccgccgctgactgccattgtcaggaaggcagcggctgttttcgtatgctgggctgtgccgcggagggagatggcgaagataatgctgaacgcaccgctctcgaagaggtagagcagcattgccataacgattgctgctgagccgtttgttttcatgcaaagaatggagcagacgatcatgccgatgtagctgaccatcagaacccagcgtggtttgaggaaccactgcgcaaacgcggccaagaaacggcccacggcgaaaacgctgtgtccgatagttaggaaatcaaatggtgacgaatctggacgagcggcaagaacgaaacgccggagagctgtcgcgaagacttcttgcccagccacgtagaagaattgagaccagattccgaggccaagagtcagccaaacgactgggataccgaccactttggtcatgttgtcttctcgacgtcgatttgcgagctcttccaaatcttcatctgacgcttcgggaattggtagataataaaacgccactgccaagagcacatcgaagagagcaatgccaaggtatgcccattgtacatcaaccagagatgcgacatcctgcacatccttgaagaggacccgtttcgccaggagcggtgacaagacacttccaactgcttgcacaccctgtgaaatattgagtctgatctcggaattctcgagtggtccgcatagcgctatgaacggatttgccgcagtctccaaaaccgctagaccaaacccgacaatgaaatttgacaaaatgaacgcgggcgtcgaccttaggacagcagaaggccaaaatatgagggttccacaggcataaatgcaaagtccagttatgaacgtggacttgaagccccatattttcaagacgggccggccaaccagcagagggccgaccacgtatccgccgaagtacgcgccatgaagacccaaggaataccatggatccaagtggacgatactcttgaattgagaattcagtatgtcaagcaagccatatgcaaagccccaaaggaagaatagcagagtggtcaatgcaattggcgcaatcgactctctgttgtttaactttaacatactttccgggtttttcatgttgacaaaatcgaagaacgtgatatccggtgcataagatgcgctagtatgagttcctccctctgtatcggcgggtgctgtttctgggtgacctaggaaatccaagataccaatgggctccgattcccgggagctaggccgaccagcagagacaccaccaacttggttcggtagtcccttatctccctcgttgctcgatggcaacggcaatggcgatgaagatcccggcgagcccgagactgcagccggaggtggcactgcaacctgactttcccctggcacgcctgcagagagtccatgaggcgaaggagttgatacatcatcattcgtgtctctaatcaacttcgggacaagacgagtgacgagaggtttgagacttggaacacaaccgcaaattatggaaagattgacttcgacgacagaccacatgaaagatagcgatgcgtaccctgcgaaaaccccgctgttagctcaattgacacatcaatttcaaacctgggagaagaacgagccgtacaactaaaatccacccctccgatgttttgaatatgaattgaattgacttccagcgagcgagaaatggcagcctgttgcaaaaaggcaattcgaaccacatcaaccacggccacaaagaaaccaaacgagaaagtgatcaccaatatgatcttttgcttgaaaggtaggcgcattgttgtcaaaagcggcatcggaagtaacaggatagcaatgtcggtaataatattcaccggcgacgaggagaggtacagggtgacaatgtcggtgcaattcgcatccgccgggaggtgggaaaggaatactgcgccgataggacgacattggaaaacattgaccaatgttaatgcgaagcccgctgcgttcactacaaacagagtgacatagtttgcccatcggaaaaccttctggttgcgcgtcatagtcaggtagaagacaagtatcgaggtcttgacggccattaacgccggattctaattggttatcagcatgtcattgtttttattgccctgcggagtaacaaagggagtaacaaagggcagttgtaactcacatataggaccgtgaatgcataattagccttattaaaagcgagtccatcttcaggcttgatatcatcggaatgaaggccaagaccattctgaaccgcatagaatagcgagaaggaaaagccaaaatcaattaactgcagacttggttagcctccgagctctagcacgaggttccagtcatcgccaatagagcgagtccgttctcgttacatccccgggtacatgcagggatcaagccgagggatcctacccatgcgaccaacatcaaccagtcgtgtaacccaatctttctgaccacaaatattcgcgaaatgaagcgaagggcgacgaagatagaggcgatgcagaaaaaggtgatcgaaacacccagcgtagcttgttgacgaccttccatgacgaatttgaccgatggactgtcccagcggacagtccgattctaacgaccccaatctccagtgtggcgcagaatattgcacacgattgtattcttcggattctagcgtaaagtcgcgatcgtaggcgggctgaaatggcgcgtgtgcggaggcgtcatcgtcttctttcccgacggagtccgaatccgtgtatgaaggaccgggagcgaaatgaggcagaatagacagggattagaatatttggagtagtcgaggtagaagaggaaacaaaaagagaagaaaaagaagttgaagatgtcagaaaagtaatgtggggagagagaaaatcaggacccttctaccccggctttggcccgccaatcaccttggacttgtcttcttctacttcacccctttgaagactcgacaggtctaggctatcatgctacacaaacacacaaatacacaaatacacagctacacagctacacagctacacaaatactattcctatccagggattgtacacaatggaagatcgcccgcatatgtcgcacccaatgaacatcctggacaaaagcgagcttcccgtgagatctatggaatgtgacacaacactgtgatggtttttgttgtttttgcgtgcagggcacctgtacgagcactttgtcaggggccgtgttagtccgcgcctatgttgtatataggcacttcgctcatggtccctgcccttccatcttcccgagtcctaaagtttcacccattggaatgcacgtggcagttactatattgaatcgacctggatgctgcaaggctgtactgaggagtgaggaacttccgtatcagaccggcggttctgggatatttgcgatcgacaagtgatctactcgccaatctttagtgtgatgtgtcacgccaaaagctgcagccctcttacctcaaactccgtacaccaaatcagcatatgtgagcatgatattgatcttctaccccagatacattctggacaaccgatcgttctcttatgcccgcatgacagtcttcgcaccgcaattcctccaggcaccgagcttggcatgtacaacggtcgacagggtggaccgattcatccatgatttctctgtcactggatgagcttcgtggtgctatatatacctacatttaagcaagcttctgattgttcacctatattccgccactacagtttcgtttgaacgccgcgatgactatttttcttaatgtcataagttcccgagtttatgcgaacacgccaagaggaaaccaacggctacctatgatcgtcagcccctgagatcagcggcttcgcaacgttacaaggaactacttgctagctccttggctgccttcaaattctcattctagtatgtaattgcgagaacccctctcggtatatcggatgctattattctccgcttctgtgctttgtgcttaatgaataaatgtgctcaccacaacgtggattccgggaatactggatactacttgactgtttatcacatggtaaaaggtgtcccaaggctatgtcggaaccgaacgagatcttcgttttgtgggtaggtagttgcatgcctttagttcaattcttctaagcgagctgtaggaccaccttctatttgttgaagtacgaaagggtctgcccgtctcctcttggccggtgatatataagatgccgactgccctggagtttgcatcaacgctgggaaggtacagagtgccctgactgcttccaaggttgtccttgtcaaaccagcggcttcgtctagttaatcctcatcgagatgagactcaacacgttgctactggctttcgggctttcggcatccctccggggtgtacaagccgagacagaagtcgagaactccatcgcttccatctgggacgacttcaaaaatgcagtgaactgcggtgcttgccaggtatgtctgtgctcggcacctccatcacttgtaaagctctttagctgactctacgcaattctacaggttctcctcggtagcattaaggttaccgcaggactcggtgaggatttcatggtcgatgtgttcaccgggttgtgcaaaatcagcggggtatgttgacagttttcgggagctactggctcaattccattaatcacaagcatacaggtcgaggacccagatgtctgcgccggaatcatcgagaaagaaggccccgcattgcatgatgctttcaatgctttacaacttaactctgatacttccaagacactgtgcgctagtttggtcgggctctgcaaataccccgaagttcatacttacagtctgacattcccttcacctaagccaaagactgtgagacctccacctagcggaaagacgccgctgaaagtcgtccatttcagcgatacacatgtggacctcctttacgagcctggatctaactacaagtgctccaagcccatctgttgcagatcttggtcagatgaagatgcacctgagaatacagaacacccatgtggaccatttggaaacacaaagtgtgacccaccacaaatacttcaggagagcttgcatgctgctatcgcagacattaagccagagttctccatttacactggagatgtggtggctcacgatatctggttggtcgacaaggccgaagctctgaaagggctaaatgccacgtacagcgcaatggaaaaagatatcggcacagtgtacgctgccataggaaaccatgacaccgcaccactcaacctcttccctgcagatgcttcccatgaagccgatcctcaatgggcctacgatacacttgcggaagattggtatgcactcacgggcattccttccgtcaagtctgcggatcaatttgcctcgtactcagccgtccaccccaacagcaatctgcgcattatttcatacaacagcatcttctactacatatacaacttctatatgtaccaggaaccaatggagaaagacccacgcggacaatttgaatgactcatccaggaattgcaggccgccgaggacgcaggccaacgcgcatggctgatcgctcacatcccatccggtgtacctgatcacttccgcgaccattcggagtactttgaccagattgtgcagcgctacgacgccaccatttcaggattattctatggccatacgcacagagatgggttccagatcgcatactccgactacaacaaccgtgagtggaacacggccactgcaatgggttatgtcgctccagcggtgacgccaacagaaggctcgccctctttccgtgtctacgaggttgacccagtcactttcggcgtcctggattacacccagtacatcgccaatatcagcgacccatccttccagacaaagccagaatgggtaccttattactctgccaaagcagactacggatccaagatctctcctccgctcacagatcccaaagctgagattagtccggctttctggcacaacgtcactgtcgccatggaacgtgatccgaccgttttccaagattactgggcgagacgttctcgtggattcgaagtcgagagttgcgatgatgactgcatgaagaatgagatctgccttcttcgcgccgctaatgcacagtataactgtgataagccgaaggctttcgacttttctaagcgtgatgggcaggagggtgatatcttgctggaaaaagagcctcatattgactgcgatcatgctggaatggcgacgctggtctcgaagatggcgcatcgggctaaacttgagcggagaagggagcttgagggcgatgatgcgtgatcatctggtagttgaaatatctacttctggacagtaataactaccaaagctaattttgataatttatgccatgcaaatgccctttcattgacaaacataatagctacgccggatatcaaaaaaagacccccctcccaaaaggatatgcgcccgagcccgggacacccgggcagttgatgtcagataacctcgtacttacatacatgagcaagaaattgagtatacatctttatatatacaccaggagcctggccaaaatagattgaggatattaatatcaacaatagctgccatgaagtataatattggtacaaatacggttgccagaaccagaaatcaagcagtaaaggttgactcaggatctacgggaagaagtccctggcgatctatcatcgcaacaaggtctccatccatcatgaactccccaagttccataccaaatggtgagagactaaagtcatcccctgtaaggcctgttcgactaccatgaagagcgggaagcgttgtagtcgaagcatcgaagctcgattctaataaacagtattgttagcgcaatcacaaatataaagaagatggaaaagagactaaccaggatcgtccaagaccttgctgaattgttccaagtaataccgacatcgatcgactaaccggtttccttcatcgagcctggaaagcgccgctactgcacgactgggatattgtctggctttgcttgctcggtctgtcatcggagttcctgttaggcttgcatcacggtagacccaaaccactccgatgaggaccagtgccgcattgaaagctcaaaagctatcagcatataaacctccagagtgaggaattcggagcatactatagtataaggagaaccaccaagctcccaaaaggctgtgtttccatccaggttctgataccatgcggtgtacgatatcaatgatctccatcgcggagtccgcgcatatctgcaagctgttcataccaatctgttgcaacaatctcatatcctggggatcgcgatcaggggacctgcttgcagtgataaatttgaccaataccgggcggtggagcaagactcgaagattaagatatctcaaggttaggatgacttgaaacttcaacgagtggtattgagaattggtcgacgtctggtcacgaggcagattctcaataccagctgacgatataagatgcaatggatgggcaagtgcccgttcccaggagaacaaatgctgttccaagctgaagatgtgggccacggtttcgctgactggcaatggatcatcgcagccgatgttttggccatagaggagctctatgacgctccagagctgcttatagagtccactggtatatgtcagaaactgggactacgggtgtaaagctcaaccacttacattgtcgagttgaagaacacaacactcaaggccaccgtctcgtcgtccacgaaccctgctggagtttcaaaatcccgtttcgtgggcagctcgagcttgacgtagccatctggaatggctgcaggtctgccgaaggtcatgctcagagttctatattgtcagcatatgtttgacgtgtggagctttagccacttaccggtctaaaaccacacaaccgtaccaagtccgctttcgcatttcctgttcaagaggagaaaatactttggacgcatgccgtgaatgtaatccaagctgaagagcggctttgacggctaatccatggacagtccatgcttgaattgacttttgcgtgccttggagatattggcccatcagaagcaaatattgaactagggacacatagtcaggacaatattctcaaagaaggcaagagttgggagctacctacccacttctagggttgtccctcgcaagatttcactcccacacaaaccaaggccacgctgataaaagacatccgattctttaatccgagcatctgcgctcgcacttccaggaattgcagtgacagtagccatagccagcaccatgttcaacagaccaagccaagtccttcgtaccccattgaagttctcccgtgtcatctggtgatatgtgtccaggaagacgggtgggtatatgtaaggaaatagcaagcctgtgttagagaaatagcgtttgatgagctccaaagtatttgcctgcggtggtaaagcaaacatgttcacctgcatgcgccggtcttgacccctctggggtggtgatgatggtcttgatgcattcacgaagccaccctcggcggcgccaggtgaagggaaataccccggttggacaatagcgctcgacaaatgtcgaagaaatgcaatattcgaagaaggacctgataaaagtttagcagtctagaacccccttatcaagcagatacacttaccaaagaacccggaatcctcctcatcagcaaaaatcaccgcacccataccatcgactgaatcctccgtcccagtcaaatcaggcatcggtgcagcgattctagtctcagcctcactctccccgacattccgaccagaaatagcagactccctttctttgtcccttcgaggaccacaatcaactcttttcgccaacccatccaaatcacccctcacagccccaaaggactcttcgagcctctttaccctatcctcaagcccatgcagatagtccttctgcacgacaacattagcggccgttggtggcggggtgtaaacacacgcaaaccccaaatcctgacataacgagcagctgggccgcttgccgtcacaccgggatttgcgggttcgacatgcatcacaagcgatagctacacggcgccttttggagggccgcccgttagatgtttcgttatccggtgaagttgatgccatttcatactagtggtgtcatacgattgggggttgtcgggacgtggttgtttctggggaagtgtcggccgggggtagggcggatagctacccggtgtttccggggtgaggatatcatccagttatggtggacagcagtcattatcttgactttttcagatatattttcaggtgtatgtctcttctatttggtcatttcttgcgataaatgaatcttggtgtttccagacttcggttcagtggagatatttgaaaagcgcccgagcatggaggtaatgctctgttcatgaatgtactattatatgaagcaaccttgtatatatacaccatttaatccaacagatatctacccaagacatgataaactcgttaaatcgtaaagcgggcttgccgcgcccagaaaatcaccattggaaacaccgggacccaaaaatactacagataaaacaatcaactaccttcatgggtagataccactatctccggggtagactgaagccccggcgatgaagttttggggctgacctcggaaatagatggtgctctacttcgcgagctcggcgttatatcccacggacctaatgttggcctttccgcaggcgctgacccaggaggacactgcaaggttaatgtcccagatattccttgtgtcgggagtgaattcgagtgattctgacgggatcttggccgagaggcagctggggtaggcagtgaacgacgtgttggactccggggcctccttgagctgccttcaccattatccacggagtccctcctgcttatgaaacttccaggccttgatcggttatcaggtgtagatgaccttttatatttatcttgtagagttcggaggtttccatttttgtattcttcacctggggtctcgggataagtcgttttcgcttcgggtttgaaccccgttttttcgatttgtttgtgggctttggcggtcataatagcacttactgcgtttaagaactgggcaacccttcgccttcctagatcgtgctggagttgggtggtagtggtctggttggtagtagggcggcgtatggttgtcatttcgatatcgggttcctgcctctcggcacttgttctagagcctcgtgcagaactgcttccggtctccgaagcagaacagtcacagtttgggcattttccgacaatagtctcttcttgctgcccatcttcccttccggcggcttccatatccgcagagaggagcagatatagtgaccccaatacagcgagtgccgtaccgacaattggcgcccattgacctaaggaatcatctgttagtgaacgttcgccatttgcattgtcgatcgcaaaagccaggcacggtaaaccatttactcaccaatgctttgcataggctctgtttggtgcctcatttgcctactccaaaagttcatttcgcctttcgcgaggattgccagcactgctgcagcaaacaccggtatctcaatgagagctaaccatttgcttatcctgtcggtaatcctggtcatatggttgatcgtagctccgttggttcccacaatcggttcatctggctcctgcttaggctttccattcgagaacttctcccagttatcgtccaagattttgatccacatggataccaacgacaggatggcagggatgcagcatgcggccgcaacgagcgtagtggcattgaacgacagctcacgaggcactgggatcacgtagatattgtcggctgctcctagtcgcaatggtgagactggcccattatctggggtacaggcaatgccacagttggagccatatggaaaatcacccgttaagtcccagaggatgcttgcctcgtcgtcaactgggcaagtagtgggtttgagacgcatgaattccacgatcaagctcactagcccagccaggagaaggactgtccacaaaaagatgatatcacggccgggattgttgaagtaagtccgggacagcctgacggtggctggggcggttaagataccgattgcgcaaagctggaatgccccgtagatatccatgtcgacagcgcctatagaatattagattcggtggtcattccgatgggtcacgccaggtaagaaacatcgacccgttgcaaaagtttcgctcgactcaccgtcgacatggaccgcagcaagaacaattccatgaagagccgcgatagcgggaaagagtaacacagcggctagacaagcgttccgaatccattctactttgcgggcaactacacaggctgcaattaaaacatagtatctggcgtgagtgtcagcatatcatgataaccctgccggtctctttgtaaaggaaacatacaggactcgggtccccgggccatattgaccggaaaccggccatgcgcaaacaacctcgtgagatagggcgcttgcagctgttgtcacgttagggggcgatgcagtagcacgatgcacaagagcattccccaggaagggggtgacaaggggaattgctggcattgcatgttatccgtctccggcgacggtaactttaggataaagcagcaaaaaaggcatatattaatgtgttgttgtgttgttctctaatcctgacagtgacttagtgaggctcgacgtgaaatcataagaaacaaagaaagaagtaaagcaaggagcttctgggccgtcttatccacgaagcgctactccgcatattgaccttggtcaacaaagcgaagagcgcatgcagcccgggtgcgagttgtttcgtcagcaacagcctcatctcggattttagagcctcggcctagctaggattggatagctctggcgggaaacctctatcgctaaggccaaagcctcggaacgacaagtgccccgtgatgttgatttgggcgggcgcagcaacccgggcgtgaatacgagatggggcaacctcagctcccgccgattggcaagttcagcatgtcatgcatattgcgcagtgggctgtgttgggcgattcgtaggtgtttccaagaaacatctatgttgtaacgattcaactcaaagtcacaagaatctcaaaaggctgggacttgatattggccgaaccatgggtccaacatattaaagccaacattaaagtccgcgggtgacgatcaacttcccaaagtggaagagtgcggggttctcaaaatgtggccaatctcgaagagtctttgactccttttattggacgttacctacgtacttgccaacagctaacaactaacgagaatgtcacttgtgtcccgtgtcttactttgatttctggtctttttgattgccctttctattgaggctcagacgtcgggactttaagcgaaaatttctctcatcctggttctcgctgtcgcaacgttgcgttagcgtcgaaggaactgattacttcgcctggattctagctcaactttaatagagcacactctccacagaacccacttcgacacggagatattccacagcctcacagggcttgcttaacgcttgcttgacattcattagcagcttgggttcccacctctcgccctcccctggtctatgtcaaccgtcataaatcatttgaccttgccgctgtgattatgaggggcagtccactcgatttccccacgtcttgataatttcacttcaagcataacagagaacaacgcgcaagtgaaatttctctggatctttgacaggaagcaactaggatcgttgctagagatctcttgcacaacagaaatgcatttgcaataaaaacaagagtgggatcttcatatgcacatttctcttgttccgcattccggtattttgtcatacccgacagtggctgaagcacgagagaggctgacttggtgcctgacggcaaaagctacccagtgcatgtccttgaacctcagagaaacagatattcaaaatgtacgacgaacttgacacatcgaaaatcaaaagttggcgatcaattatcaccttgatcatttttgttataactagtaagtgtggctgtgcctagaatgtgagattgagacttacttttggcttctttgcgcagataccattgtccttttcccattccatatccctctatacctacctcgatggctcaccaacgggtttctggacatcttgagtgccatgcgcataataccccaccggactcgttctcgttccgatgacaagcaacccatttttgtgaagtttcgctttccattgaactttgtcacggcgcctttaatagcggatctgttccttctcgctattttggctattggccgaaaagaggtacatgatggaatagtcggggccgacaacattaatcccattgatatcatggtcttcttcctcacactcgcctatattgccatctcgattgatgcctcgggccttatcagatatctggccttcagggttctccaaaaggcaggtaaggtcgggcaccgactgttcttttacctgtttgtgttcttcttcgggttaggtagtttcatcggaaacgacccgatcattttgtccggtacagctttcctcgcatacatgacccgtgtatcaagcaatatcgtccaccccagagcctggatccacagccagtttgctgtagcaaatattgcctccgcgattcttgtctcctccaaccctaccaacctggtccttgcaggcgccttcaagatcaagttcattgtctacacagccaatatgatcgttcctgtagttgtgacggcaatcgttcttttcccgttcctgctatatatcattttcgcggacgaatccctcatccctctatccatcacaatgcatgagctttctgaggaccaaaagaataaaccacccgtgaaccccaacattcctcatgccagaggaacctccgaagagaaagaggaagcggatgatctggagggaaagcagctctcgctagaagagatcatgaacccgttcttagataagaagggtgcatctttcgggggaattattatggccgctacgcttatcaccctcctggcaattaatgcatcaggcaaagagaatcccgttttctgggttacattgcctgctgcttttgttatgttctgctgggatctcgcatttggttggctccatcgccacgacacccgtgagattgccgcgaagggtcgacaggaggttgaagaggcacagacagagcgagaaatgcgcagacaagaggagcagcaaccccggccaaacattacgggtccggatacctcggggtcggaccagcctgggcaatacgatgctttgggcatacgccaccacagcgagcatgcggatggcaatacctcgcttaagagcaccgatagtgatgtcgcctcaaagaaccctggcccagagtgcggaactccatggtcagcttctgtcctcgtcgataaggaaaagttcccagacctacagacaggcggcgttgcgattgacagtaaacaactagctcgcgcaacgactcccgaggcgctggactcgagacaaaccaccgacacaacgatcgatgaggagaagccaggatacccatattttcaggccaacggcccacgcacgttggtgtcgctcgctgctgatctctatcgctggtcacaggagacattccccaccgtgacggtcgtagtatcccacatgcctttcgcactggtacccttcgctttcacgatgtttatcctggtgcaggcgcttgtcaccaaggggtgggttccggtttttgcgtacggatggaaccactgggtggaaaagaccggggtaataggcagtatcggtggaatgggattcctatctgtgattctgtgcaatgtgagtattcgagcaatgggctgaccacttcttctgtctgaatttgaaccgctaactcgttatattctgataaccagtttgctggcacgaatataggcaccacgattctcctctcgcgcgttatacaagcatggcagaagatccacgaagccaacggaactcccatcagcgatcgcacatggtgggccactgtgtacaccatggcacttggagtcaattatggcgcatttagcactgcgtttagtgcttcgctggctggcatgctgtggcgggatatcttggcgagaaagcacatccgtgttggcagcctggaatttgcccgtgtgaaccttcccatcattgctatctctatggtggttgggtgtacagttctcgttggagaagtgtatcttgtcagaagtgatgagccctacgtgccatcttgatgtgtggattgcaggaggctgttgtttagatgttttatagattatgatgctctcgatgcttgtttcgtgtggccctctgtcacggaacgggcagacgatcttacgaagccaatgaagaccgctttacagtttttcagaactgtgtccatgggagagtatcttcgacaagtgttgttctcattgtgggatttccacttattccaggggttgtgttacgttctatcacttgatcgaccttcccacgatactctaaccacacatgcaaccaagtgggcttcaaggcttcactcatccacaagggactcaacgtccatatcttccgagcgatagaagcccaatgcatcaatcatgggcttgtcgtcaaaccgatatagataaaccggttcatcagcatccgcaaagtgctgatatctgtaccacgccggaacacagaaggtatcaccctgctcccagatatattccttatcaccgatagtggagcgtcctttgccggtgatgacatgatagacagcggacgtagtctcgcgccgggaaggcgaagccttagatgccgaaattcgctcagcacatcctccaaggacgcgactcactatgaaaatcattagccatcttcccacctaccgaatgaaagtataaaagagggaacgcgtaccttcgcgcccgtcttccttcaagtatctcttagtagcccaatccccagcaaccccatccaactgtgccttcatggtaacccacgggaaaactaatggcgaagtggtactatcaacattctccgcgggatagcggggcttatcgaagtgctctacaaagtgcacagggtagtgtctgaaattgggtaaatccagcccatccaaccacaccataggcccagagccatctttgccgtggtcatggtagttccaggtcggggtgaggatgacgtctccgcgctgcatcgtaatgcgcctgccgtggacagcagtaaaaccgccctggccttcgatgatgaagcgcatggcaaaggccgtgtgtcgatgagcgcgtgcagtctcgttgggcatcacgagctgcagaccagcgtagagggtgtccgtagtgaaaggggcatcttggataggatgtcagaagtagttatacgcagtatatgaaagtaaaactctatgaggcaatgtgaaaataaaagataactttgtacatacctcgagctgggttggttagcatcagcacccggcgctcagcctgagatgctgggacgagatttccagcgcgctctaagttaggcctgatggtgctgtacttccagacatttgggactgttgtcgggtttggcgctggggggttcagacgagccatctgcttccacagaggaagggtcttgcttgcttcgaggtcaatgagaagctgttcctctgtgtcgaggacactttccacttgagttgaagtcattgttggggtctttgtagtaatgagaaatatctttagattgtattgccttcattctatggagaaatgatcgctaagatatatcttgaccactttcgtaagatcgtcctctcttgctaaggtccggggcaagaccgggtagccttccccggtgcaatccctgtcgaggagtcataaaggcggtgatccgatgcgctgttgacgaggtccaattatttgactttgaaacaaagaaagtgacaataagcaagatggtgtccaatggtcaggccaatggctatgtctctcaggcatccttgaaggtgggtttctcatcccgaaacggcaatgtcagcgtctcaaatattgatgaacacatgatagaccccaacataccccagcaactgcctcgaattcttaaatgatccattagcagttgagaagaccatccctgcaaagggccccctaaaaattatcgtcgtgggtgccggactcggcggactagcaacagccattgcgctcgcaagttccggccacactgtgactgtgtacgagcaagcacagaagctcggagaagtactggctatcctctattggtgttaacaaaagctgatcgcgtaccacaggttggcgccggtatccaaatcccatccaactcaactcgcctcctgagcagactcggtctggacccgtatctggaagaatatgtgaccgagcccgagtccatttctttccgacgctggcaatcaggagatgtcataggcctcacacggctcatcccaagcttccgagaacagttcggcgcaccatactatgtgatccaccgcgcaaacttccattctgcgctgcatagacgcgccctggatctgggtgttacggtaaaggttgcttcgaggattgttggatatgatatcgagggaccaagcattgttcttgcgaatggggaaactgcttcagctgatttgatcgttgccgcagatggtgtgggtctccttgttcaagatatatatgaccggttctgatactttgtaggtgttaagtcagttgctcgtggaactctcgatgagagcgacaagcctgcatttgagaagactgggtttgcagcttaccgggctaccgtggatgtggagcgcatcaaggaagacccggaggtttcctggctgttggaaaagccggctctcaatatctggttagcacaagtatgcaaggatgttcgaaattagactgaccattttgctaggattggtgatcagcggcacgtaatgacatacaccattggagccggcaagtctttcaatatggttctctcgcatccagatgacagtgatcctgcaacctgggatcagaagaataccctcagtgatatgagacgcgagttccaaggatgggatacccggtataagtctatggatcttcctggcatgtgtccttgttaataagtttacaggcttgagaagattattggactcatcgagaaaaccatcaaatggccactgatcagtggagtcccgctatctcgctgggtaaatggcaaggttctaatactaggagatgcagcacatgcaatgctgccttacatgtcgcagggtaagtgcagaatcacaattcacgttaatagtcactaaaactgcacaaggtgcggcaatggccgttgaagacggcgcagcactagcacgaactctgtccaaaatcgaggataccacagatatccccaaagcgttgcgtatattcgagcaggtccgcattgaacgagctggaatgatgcaggaggcgagtcttctgaatggaaagctatggcatttcgccgatgggccgctgcaggaagcccgtgatggagctatgaagcccgaaactatgggtttgcctttcagtcacagtcctaaccagtggagtgacccggcgactcagatatggtgctatggatatgatgccgagcaagagattgatcgagcttggacgaagttggaattgtagagttttcaaggctgtttccaaagggaatatcctacttcctcttgaaggactataactatgtacctcatatttgatgtatccttcgttcccctgtctatttgttctatctataaagaagtacaccggtaccaggtctctagtgccttcccctttgcttctgttcatcagtatcggtctagacactatagacatccgatccccggaagaataccttatggttttccgaaggaccataataataatcataaggtttcgtcatttcagttaccccaatttccccatctcacatttggtcagctacgagaaccccatcccggatgtacacccgacaaacccggtatacccgatctttccccgtcacaacgacagtaaagagccatataacgccccaaccctcgctatgaattcccttctattagccaatcccaattcaaggaatcgaatatcaagaaccaaaaagaaatccgaagccatgtctctcccgtggaaacgcctaatccgcttcatcgctacagacggccgcaccctgcgcggcgagccaatcctccccaccccaacaacagatctgggctttataaccgagtccgacaacctgcaagcacgagtgatcgaaggcgacgacatctacgacacgacgggcaaaacacgcgtcactgatgagatcgtctctgtgaagaccatcctaggcccattggcgcaggcagatgttcctattctgcgttgtgtcggattgaactatgcgaaacatggtaaaatttcccacccttagtggaacaaactctctccgaggacagttacttatacatatcgaccgtgtcaacagtcaaagaagccggccgcactccacccccattcccatttatattcttcaagccaaacaccacaatccacgaccacggcgcaccagtagtaatcccacagatcgcacaggactcacaggcagattatgaaggcgagctcgtaagacaagtcccctgtttctaccctgtcctggggtaatatcagtatactaacaaacgcccatagtgtcttgtaatcagccgcgacgccaagaacgtctccacggaggattcgctttcatacgtagcagcctacacagtcggcaacgatatttccgcgcgcaagctgcagcgcgacccggcgctcgcgggacgtgttccgcaatggggattctcaaagggctttgatacctttgcgccgctgggaccgtgtcttgttgctgcgagcgatatctctgatcctagtaagcttctgctgaagacgatcattgatggggaggttaggcaggaggagtatgttgcggatcttttgttcgattgtgcgtatctagtgtcgtatctttcgcagggtacgacgttgcagaaggggagtgttattatgacggggacgcctggtggtgagtttcatctctttcgtggttttctttggttggattatttgagctgacttgtcttaggtgtcggcgctggtctctcgccgcccaagtaccttgtccctgggacgcagatggatgtggttattgatggtattgggacgctgaggaacggcgtggtgttcgattgagctgaatcatatgttgatcgttgatggtgtttagggctcgagtatagacaggcagacagagatcgccagagcacttcttaattgatccaaaattcaagacaataccgtaagagaacgctatacagcatagcctgtcttggcccgcaatagagcgtcctaaagtagaaatgaggcgcagcggtcttagcattgaccagtacggagcagtcacagtcactagccttgcgttgctgtggttcattcccccttttggggtcgacttgggtctcaaaagtggaaaggggcgaggctactccggacagaatactcgtataaacaaagagccctcgaaataatacctggatactactacgaatactcgaggagagactattggagcaaacacgagtcaaacgaatcgagtttcattcaatgatccgcctcctgcaatatgccttatgtttttgtttgtttttcgtttcgtgagcatgatcatcgtaatcgtcattggcctgtcgcatttgcatgttcgagatctcgtaagagaaaccgtccatgacttgccagcatgcgcgcagggatcgtaagcttatgtgttatggccgaatggggtccatcatagggtggtattgcacaagaagactgcgaagagaagattctatgaacatgaaaaatgggtaaaatgtgaatgctgtccgctagggacacgcgaaatggtaaaaagatccagggtcaagggagtgaacgaaaagtaaaataagggcccggtctctctgagagataaatgattgcgctctcggagagaccgggaaagaaggtcgaaagatcacagtaaagtgaaaaaaaggtgaaaaaaaagagggaaggaccgtcaaggccatatccacttgcgcaatctaccagagatgtgtccattgttcgtattcataatcgtggccatcaacaccaacgcgcggtcgacgcgacatttagtggatgaaccacttggcaccagaggcacggcccttgtccatcggggcaagctcaccgaagaagtgacgagacagatcgacggagccgttgtcgcagcccatgcacttgtcaaccacaataccggtggcagtctggccgttgtatgtgacggtgacggtcttgccgcagtcactatcggtcatgataccgtggggcagggcgagaacgttctcaacggtaccatcattggtagtgccgcaggagctggggttggtggaggtagtggcagtgtcgtagaaggtgatctcgccggtgcaagggacgccctcggagcagacaccggtgcgggcgctcttggtagtggcctcggtgttggcagtctcggtattgacagcaggggtggcagcgggagcagcaggggcagcggcagaagaggtctcggcctctacgacgggagctggagcgggagcgggggcggaatagggctcggcctccacggtgggagcagcgggagcggcagcggtggaggaggtggtcggcgcagccttctcctcaacgataggaacagcggcagcggtagtggtggaggaggtggtgggcgcaaccttctcctgctcctggacagaggcttcaacagcaggagcaggggtagtggtagggacagcgttggcgaccatagggaccacagtagcggtgttagtggcctgggggtagacggtggtggtgacatcgacggtggtccagacgatgtcagtcacggtctcccaaacgacggcgcgtttggcaacgggggccgagtagccagtcatggcgaagaaagcgccagcaagggcgagagtcttggtgataggagccattgcgaatgaatcggaaagatgactcgagagagagtgtgttggatgttgtttaaaggattgatcaactgcacagcaggaagattggattgagcactcgaaaggaatgtgagtgagcaagaaggaaggaaggaatggactgagagagaagaaagagaatgggggaaagggtctcgactttataaaataccgaaggtaaggcacaaaagaagaaaaggacccacttcgatggttactaggccccacttatcggccaaacccatggttcaaatcaagccacgatccaaactataagcagctcactccctttcattccttacaccggactacggagtatactgtactaagtcccgtatattagaatagataaacgggggacggagtacgggaagatcacaatcacatcaagccggatgccccggtagattctcattggaacagaaaaaaaaaagcccaggggcttgtgcgccacacaggccaattttctcctcgccctaatctcgtctggggatagagcgacggctgcttcagccgatcctacgactctactgcctactggggtctgacgacccacatattttgcttcgggtacctggcaagttgacctatcagagacggcaaattatttcattcttttccacgatttctttcttttgaaccatatccgctctttttcatatcgagatctcagcgtaccttgctcgttagtcgccttgcaaatgacgtgtgtcgcggtgtatacagtcgcaatgcaccccaggggaggactggtcagattactgcagtctgccttttcagtcttacgtgtgtgtgtgtgtgtgtgtgtattgtatcgggccccgggatcaataccgatgcgattggacaatgcatgagacaaagatgacattccagccaatccagctgggatcggggcatattttacttgtactccgcactccgtgtactattattatacaggtaatttaattctctccactgtcaacggtctggacttggactatgttttcaaaccgttttttggggttttgggtttttagtgggagaatagcgccgatctcttcgatttcgattgtgtgaatatcggagtactccgtagcatgtcaacacctacacctattgatgagccttagaatctgatctcttcactttcatgatctcatctgtctcactgtgctccgtactcaacccctctttgcagccctaaccagccccatcacgaaatgcagggcacagggcacacactcggacgttgaaatatccaacagaacctacataatcgataccgagaacccgatcagggtgctgactatgttccccaaacaatcaagatgcaatcgaaatgcacctagagcgctgactacgcatcccctagtaccggtgggcctgtgtgtattccagacccaaccatcctcttcccgagagggagccagaccctgtcacaccaatagcactggtacgagctcgccaatttggttggcatccattctctatgctgtagtccacttcggccattcccctcttctccactcgacgatctcctcggaataggattggatgaccatggttggatgacatattgcaatcaaactgcagatttggataatttgaaaggagagggggttgggactggaattatatgttgtactctatacctaggtctctggcaacggggaattacgcgatgccgttgaacgtgcccagcccgcagagtggatagagtgctctctacccatacaataaaccctgtccataccatagctatacgaaaacatcaagctttgaagctattcccccttgtgtcttgaaaacaaagattctggtaagttttaccagtactatacgttctagaggcttaatctcgtccgaatcgatcgtagggatggtgagccccggttgaatttttttgtagcccgttttgcgcgcttgacatcacccattccttcctcatcttcacaattataggtccatcaattcgcatctgcaaggtctaagggcttgtaggacaatgagcgcttcgtaggtcattgttctaaggcgctttcttctttccgagggtctgctgtagaaaattcgcggtttcgtcaaggtgctccgctccacagtggccagatagaaattgaaaagcttcggaatcccacgatgtagctttgaaactgatttcctcttggactaacttagtggccttttcagcattcgtcgtatgacagtcgcgctcggaagagaatttgtcacgtctggtgaaagctggtgctctcgctgcggatcttcaccaccgaatatttggaactctggctcgttttctgcacgatcaagcatcggttgagtcacccgcaggagacctgtatccgcggaggcatgtcgggtcgtacgagatttgaaggcttgttcgccaatttcgtcagtgcaaaggaaatccttcgaagctaaggccccgaatcgcggattcttgtatctttcaccgatatgcctgcttaagaggaagaagaggtttttgatcaaacggctgtgcaaaatgcgtcccatgaggcatagaatagaagcagagagcattgtgttttatatataaatcgagatatagatgatgcaaaccatgaccgtcgaagaggagccgtttgtaccttcctaccgatcttctaggattctcccccaaaagtctaatggaatctataccaagctcatcttgtccacctggtttcggggatcgccactcaatatttgttagggacgttgatctcacggtaccaaagtcgagggtgcgttttgccctttaggaaaatgtatggaggtagtatgtcgccagtgtcccctcgccatattcctctatcggtgtttgccgtaatcgttcaagatacgaaagccagttcatcaagggtataatatattcatcggacgaacacccccggtggggatatactgctcaagttgatcagtaaactgctgaacgaggccaatatctccgcattattccatttcgtatcgatcgtacgacggttggcacctttgaactgcgatgggagtggtgcaaggaagcggtagatctagttctttccgagctcttgtggtcgttcccgcatagaatagatctccagggctggtttgctgccgtgatgaataagagataccatatctagaagcgtggcagtatcaaccgggactggccggccgcaattctgggccgatcattggacccacgcgggccgagccaaagctagcgcgcgtgtacatatcaggtgaatttcactctgtatcattggcaactcaacaaatgagtgcatgccagcgtcatttatatgagccactcatgtgcaaatcccacatgtcgcaacaggttcatcacagtggggatccaacgaatctatcgaccaatgcttaacaagatattgtaggggctaggctctcccctgtcgacagtcagcccattcgccttcgactctggggaaattatgaaaccgcagtcacctcctatgcgctcgggatggtcaacgcgttctattattgtctatccgatgacaactgagcatggtgttttctgcatcccaattacgctttgtacaactcgttctgatcttgttcggggccatttttatcctcttcaagctacgaccgagcattcacaaggcaaccgcccccatccagcagggctggagcgaccatcatgattgggacgactttggtgccatcataaatgacacccttggggtaatggttccatttcaatcttcacctggagctctttcgacttacgactatttaggttcaaaaagtcttcgccattaacctcatcagccggcctgataagcgcgacaatatcattctgggctcatccctcagcaatttccacgtcgaatggattgacggcgtgactccggatgaagtagatgccaaatcctatccatacgtatgtctccaaactcacacaatacacgcgacggctgatattttctagaactggaaccatggccataaacaggccgagtacgcggcccgacgggcacatctcaacggactccagcggtatgtggtctggaactgcaatatccgacatcaactaattatctcctagaattgtccaggagagactatcaagtgctattatcatggaagacgataccgactgggacgtatcaatcaaagcccagcttcaaagcttcgcccacgctgtccgagccctccagccccaggatagccggaatgtcccgactcagtcaccatacggcgacgactgggacatcctatggctaggccactgcggcgtgtcatgtagaactgatatgccattttaccttaccccgaatgatccgactatcccaatgccccatcactttcttccactgtggcgcgaccctccgacattcgaggggtacgagagacccgatcacagtcgacttgcgtgcacagcaagtgacgctgtctgctccatgctttatgccgtcagctacagtggtgcgcaacggattctcgcagcgttgtcggttaacccgtctggtcttgcagaagaaattgatattggtgcccaatttgacgtctcagttggacgcatgtgcggtaatggttatctgcggtgttttgcaccttatccatcgatcacgggcagcttccatcaggcagggtcaagggcaaagtcttccgatatcaacaatgagaccggtgaggtagaaggcttttccagctggggagtgatgtatagcacaatgctcaatatcgaccgtatcctgaagggggaacggaccgttcatgcaacatggggcgatgtagatgtgttggatgtcattcctgaagacatcacaatggagaaggggtctatctacatccctgagacgaagaacaggaactgaagctaacagaaagagaagttgttacatggcggtgaaatggatattagactatatgtacggaatctaaattgttcgcaatcttggagtaaataggaatgaattctatactacttcattcataggacctgtacgggaggaaatatctacacttgtctacgaagtctacaagccctggagagaagaatggataacgtaacacgttattgaagtaataataaacaaatccaggaaatatcatgaacccacgccgaaacacacgaacaaagggaaaaagaagaaaaaggtccatcaaaatcataatatggtacacgtgagaagccacgaccatgcacgaaactcaaagggaaacatccaaaagcattataaggaagacagcttagccctggcacatgatgcaagcatccttgttctcgatgctgcactgcagggcagcatccgagtagatatcgccctccgcagccctgctctcggcatcttcaggctcagcttcagcgccagcatcattggtcttggcctcgacagcgggggcagcagcaacaggtgcagccacagtgcgcggggtctcctcgacaggggcggcgaccttagcggtagcgggctcggcgccgttggcacggggaatggccgagtaagcggaggcaccggtgccgccgacacgcttcttagagcgagcgacgttggtgtcctcgaccaggagctgctcctgatcgacggtgaactgaatgggggcggaggcggccatggtacgcaggtagtacatgccggtcttcagacccatcttccagccagcgaagtgcatgctggtgagcttgcccatagtaggctccttaaggtggatgttaagggactgcgactgatcgatgtaggcaccgcggtcggcggccatctgcagaatgttgcgctgggagatctcccagacggtcttgtacagggccttgatatcggcggggatgttagggatgttctggacggaaccaccgtcggcaatgatgcggttcttcatgttgtcggaccacaggccgagatcgaccagatccttcaggagccaagggttcacgacctggaactcaccagccaggacacggcgggagtagatgttcgaggtgtagggctcgaagcactcgttgaaaccaagaatttgactggtactggcagtaggcataggagcgaccaacagactgttgcggacaccagtctcggcaatcttggccttcagggaggcccagtcccagagatcggtgggagtgcggtcccacatgtcgtactgcaggatgccctgcgagacgggagagccagggtaggtctcatagggacccagcttcttggcaatatcggaggaagcagtcaaggcaccgtggtagatggtctcgaagatctggatgttgagctgtctcgcctcgggggaatcgaatggcagacgcagagccaggaaagcatcagcaagaccgttgacaccaagagcgatggggcggtgacggaagttgctcttcttcgcctcaggaacggggtagtagttgatatcaatgatcttgttcaagttgtgaacgagaacctgcacgacctcgtggagcttgccaaagtcatactcgcctcgggcagagtcgacaaaggtggggagggcgagggaagccaggttgcaaacagccacctcatcaggggcactgtactcaatgatctcagtgcacaggttagagctgcgaatagtacccaggttcttctggttactcttcctgttgcaggcatccttgtagagcatgaaggggttaccagtctcggtctgggcctcgagaatggcataccagagtttctgagccttgatggtcttgcggccacggccctcttgctcgtacttggcgtaaagggcatcgaactcctcgccgtagacatcagccaggccgggagcctcgttggggcagaagagtgtccagtcaccgttggcctcaacgcgcttcataaagaggtcgggggtccacagagcgtagaaaaggtcacgggcacgaacctcctccttaccgtggttcttccgcagatcgaggaattcgaagacatcggcgtgccacggctccaggtagatagcaaaggcaccagggcgcttgttaccaccctggtcgacatagcgtgcggtgttgttaaacacacgcagcataggaacaataccgttggaggagccgttggttccaccaatgtaagaaccggtagcgcgaatgcggtggacattcagaccgataccaccggcggtcttggagatcatggcacaagtcttgagagtatcatagataccctcgatgctgtcagcgctcatgtcaaccaggaagcaagatgcaagctggggttggggagtagcggcattgaacagagtgggggaagcgtgggtgaagtacttctgggacatcaagtggtatgtctcaatggccttctcaatgtcctcgccgtggatgccgacagcaacacgcatcagcaagtgctgggggcgctcagcaacggtgccgttaatccgaaggaggtatgaacgctcgagggtcttgaatccgaagaagttgtagttgaagtcacggtcgtacacaattgccgagttgagctcctcggcatgcttcataacaatctcatagtgctcctttgagatcataggagcaggcttattgttcttggggttcacataatggtagagatcggagatgaccatagagaattgcttttttgtttgcttgtggaggttcgaaacggcgatacgtgcagccagaatggcgtagtcagggtgtgtaacagtcatgtatgcggcggtctcggcagcctgagatttagatgttaacataatgcctcaagctgggggtaagcagacataccaggttatccagctcaatggtgccaacaccctggtaaacgccagagatgaccttctgggtgatggctgcagcatcaatgtgctcggggtcaaggccataacagagcctcgagacacgtgcggtaatcttgtcgaactgcacgcgttccttgcgtccatctgcagtttgtattcgcgttagccctcaatctgaaacgtgaggcaagctcaggtggctgtggcgagatggaggagcagaagctatctctcgccaccaatgtctcttgagtatcagacgatcatatatgcacttacctctcttgtagacgaacattttgaaaatattgatgaggtgataggggctggaaagaagagaaagaagagaacaggggggtatcaagatcacagtaggaggattgagatgatattagagtatacagaaaggggggggggagatgtaagcccgtagaggggtgtgagaagaagaagagatcagaggggcagaggaatctttggttgccgagtggacgcgttgtcttttcgcgtgcccgcgttttttcagcttaccaacagagggatccacctttgctttcagacctcaacgccaggcagaaactgtccatttataccagatggagttagtgcggtggtactaacgatcctagcgtgggtttactagcgaggatatagaaggcggtgtggatcgagaacaggcggtgaaaatgtgccttgcaggtcgtggatggtcacgtgagcacgcgaatggtcgcgcatggaaacatggcatcggaagggttgccgccgagcggcctgaagcattccgggctcagatgatcttcaagttccaaggctacgtgtagattgaagttaggtttttacagctttaagttcgcccgatgccctagtcacaacatcatatgcaaccccgattcgaaccttgcgacccttgctgcattcattacacatcaatgtgatggatctacatcgcattctcatcaagggggcaagaggtgcggggataacttcgagaataccttgtatggactgttcgttctcttctactaggagaatacgctggcgtcttttggtcattgattggatccatttgaatctgtccacatcgactgattggcaattgaggcagacataactgttttcaataattgtgctgtacgaagtgaagagcacataaatcaatgcgatattggcaaataagaagataaaggttcaagatcaaatattggcatcaacgagcaacatatcaaagaattcgaaccacatccctgaacgacgataattcagatcagatcgaaaggagcaacatcaaggctaataatatatgctcatggatattcgcgttaggctgctctcagtcaatgccgggttcttacagcaaagcagcagcgccgaggaacaccgcagcaacaaaggtggtggagagctggcggtcggacgaagcggcgttgaaggtcgaagtaggggacgcggcggcaccagactcggaggcggtgccattgctgactcccgaggtaccggcggcagcactggtgccagtgccagtagcgacggcagaggaaccagtctgggtagcagtgacgaagccggtggcggtagaggtctcagaagtgccggtagcggtagaaacattagtctctaaagagaagataataagtaagtaaccgattcaatgatataacgtggtgttgggtatgtgttgatccttaccaactttgtggccgagctgggcgcagttgttggcgaagaacttcagggaggcctcgctatcggcacagttcttggagatagtggactggatcttgctggcgttcgagccgcagatagccttcgaatcggctgggttgggttgctggctagatgtcatcagtatcaagactccactgggcattccttccattccttcgaacacacccgataaccttgagaacacaggccggggtctgcacggcaatcacgacattagccagagccacaatggcaatagcaaagatcgacttgttgaagagcatgatgaaagattggggatcaaagatcgaggattggaaatggaaagattggattcaagatcgcacagcgagtctggagtaaaaagagtgtgttgggctaaagagcgactgtagagagtgtggaagagtggaagagtggaagacaaagagtgacgaagtggtaaggaagataaggtctcgaccagaggaaaacgggggggagagaaatcgggcaaccacagtttcatcacaatctggaaaccacgatgggggttcaggatctgttacgttacattaatatccttacagagatgtacccctattattatgggtccatattagtggtactttacagtacgtgtcattttaatacatgtatcttttgttccccatagcctgtgacacttcggctccgaaagtggtttagcgtcagggacctgtccccagatacaggagagcgtcaactgtcagtcttgaggtgtaagggaacatatggatgtgctacttgagaggtttcaaggttatatttgaaggtattaatcttaggagtggtattcggaaggattccaggtaaggcaaaattgttttgattttctttttcccattaatttgtgtcttagtggctgatccagatggggattagagggtttgagctctattaataacctcactttacctctagggctagatgcaccaaccttggaaggttagaacgcaataagatgtacttatgtggtgtgaccaatcctacctacctacctaggtaggtaggtctcgagtagtaataggctttaatcacagactaacatttcaatgttccactaacgcaaatctatttttttgtcgcactagaacgaccaaaatgtcagtggactcccgaggtcataaaatccctcggatcagagtttaagtttggtttgatgggttcgtcagctctatcaacaccccgctgggtcatcattggagccccatattcttggccgagaacgacgatccattcacttccatgctcctccatcgacttgaagatcttctctgcctccacccgtggtctctcaaagcaagaaaagactactataacatgtcgagctggaaggccagacataagcgaagtgcgggggtcatttggtggcagtgtgggatgtgatcagaatccaccaaaacggatgacagacggatacaagagggcaagttacgttcgacgcatatgtacggtaggcaccactctccgcctctgtctataatctgatacaatttgaccaatatatgattggggcataataataggaacgttacctaaaagcttatcgtcggattttataacctagaaccaagcttcgtcgacaatcccactcacatgcatcttgacgtctcctatggaggtataactaagtgagatatgctgccgccgtgattgtgaccgtatttgagtgtaatgggctaccttggttaatcgtaagtgctatataatccaagcatgaacgagtctggggactaaggaacttcttatcgagtcctagttgggccttgatgtgcggaagctattcccacataaaacaaagttaggatattcatatcaaaatagtattaactctgtacatcatatgcctttgtaagatcaacacttgaacacattgcccgctcgtcataacttctcccaaacaggatcaaaaatactagtaacaacctcctgcaccggcagcctttgatccacgatctccctcccattaaccaaatcattctctctagccctctcatccgcctcagcttcatccctcgcaatcccagccttaacatgcctaaccaccaacctcttcctcgcaacctcaaagtcaacatccacaaaccaaagctcgtccatcaacccagcagccgttctccacggctcccgatccaagctaagataattcccttcaaaaaacaacacccgacaactcgccgggatggcaatatccccatcaacaggatccttaatagcatggtcaaagcttggcgcgtagagacagcccgtccgggccgtaagcggttcccgcagagctcgtacaagctcgaggaacttctcgccgtcgaaagtaaacgccgcacctcgtcgcgcggccgcattgaccggatctggcatggcggctaggtgtgcgcgcgtgaggtggtacccgtccattgggagggcgatggctatcggtgttggtgtttttgggttctccgaggtgtagattttgttaattcgcgctgccatcattgttgctaggcctgttttgccggagcctgggatgccgctgatggcgatcattaggcgcgcgtcgtctgctgttgagcagaattttgctggggtgggttgttagcgtttggacgtgatcatgaggtttgggagggcgtggacgtgacagagcgcatgtttcaagcgcttattcttagatgcgtagatggagatttacttaccccaggtcttgttgaccagtcggtctacctgttgatccatggttgactagtgaggtctgggatcaaatgtgtatggaaatatccggagagttggggttgcgcaaggtgtgatacgagtgttgatcggcgtacagtcaatgtttgacggatctaactactttgtatttgttacttgcctgagttgttgaacctaagcataacttcccccgaacatattggcggggctcttccgagtggggactgctgtactccgagacatacgtcactttaacttgtcaggtacacctttatttattggaatgcctgttttatattcatcctctagaccgtgcggtatccaaaaatgtgaatatctacaagaaagatgggtctttgtccgtctgttcaattaaaatcggtagataaaccggacggaatatgaaggcaagaatgttaagatcacaagacagcctcaaaaggacctgtcaacctgtcaacgccgtcgcaaaagcaaactagaaagtgtgccgtgtaaaattcgccggaaaacgccattgccaatatcgccaatatcaaatttcatgtcattccctatcacaacctgggcggctgtgttcaattgttgccattggctcgagaagcgccctcggtgtcggtggagtccatgctcgcattgagaccacggtcgagagtgcgtgcaaggccagccgcggcccaccagtcgtcgggaatatcctcacggcgggcaagtcgatccaggatgacctgcatgtggtggagatcatcattttggtggcgacgatcggagagggtgggattttggtcgtgcccgtcggagagagcaagaacgcttgcaggaatgattgtagggataggaacgggaggatggctgctcattgtggaatggtggtcgggaataatgcctgcccgtcccatgaattcctggagagcagagggatgatcctcgtcatcggaagaaaagtcacaagggttcagttggtcaggataggggtcaagtccgaagtgggcacgggaagcttccgcgttcatcggctgcgtcaagttgacagaggttcgagaacgagcattgcgcgaaatatctgggacagcggcagaagttgaggtgaaagaagtattagtggatggaagagtcgcatctggtgtaatggttgagagcaaagtctcccacgcatcggtttcccgctctccatctgggctgggactgcgctggcgatccccaagcccgtctacgacggggtctcgggttcgtcgagtttgtgtgttgtgggaccgggtttctggtgggaatgaggtattggaggcgcgatcactgttatatctgtcacgcatagggggcagacgcacgccgctgtccgagggagtcgaagaagcgctggtgtggtatgcgagggcgggagcgaagttgggagtcaatgacgggctggcatgggtattcctaggctgaccgtccatgcgaccgagcatatcggtcaagacttgatcgcgatggttcctgaatatctggttggctagctctctctcagtgtgtgggggcggctggttggctgtctctgcctgcctcgcagcgcgcgactgagcccagttgatgagcatttcccggtcggccggttccatagctactgcattctcgatagccccatgtggcgtgataaaagaaaagcgcggcacgcgtctaggttccacggcgccgcgtcggagctcatcgatgatctgtgaatgaaacgaagccaagacatcggcacgccgcacgcgggagctactgtgtcgcgacggtcctcggcgaatcgacgagcgtgcagtagaagatgagtccttttccaaagcagacttagatgcttcagatttggagggctcacgccacatactaaagatcaaagttagcattgtatcgcgaagcagtggcgcatgcgatggcttcgcgcgccaatgtgaagatgagatgacttacgggatacccattttgctttggggctaaaagaaagagacaaaagaacaaagatatttggaaaagaaggacaaataaccggaaaggcaattattgaactagtagaacacgacttgcgataacggtggagatggttgatggagacgggggagattgggttttttcgcctgaggctgggggtggctaaagtggctaggtcacgtgcgtattaatctttcaatagcacacttgtgcaatgtctttttaggcaaccaatatggaggattgcttcgtaactctttattcaaattaactgatgaatgtctgaattctataactaagcacctctcatattgtagcaaagagaagagatcgatgcctgaggcataatataagatcacgtggggatattcctccgatcacgggaagctccgaccttttgaaggtggactaccgtaggctacgctcattttggctttgcttttcttactgacaatgaagctttgaagtcctaaacctgtgtgttgctagcttatcctttcgtcaataatgacaattgaccgcgaaattgctatcacgctacactccgaggaatgattgaattaggattgagtcgggttgcgagtctgcttcagcagactccgctgtcatggaaggccgttcacattgctggaaccaacggtaaaggatctatcagtgcctacctctcccatttgctgtccaccggcggagtgcgttgcggccgcttcacttccccgcatttaattgatcggtgggactgtattacaattggagagaaagtggtccaggaatcccttttccgacagttcgaagaccaagtcaaactacgagatcaaaccctaggcatcggtgcctccgaattcgaattgttgaccgcaacagcgttcgagatattcaaccatgaacgggtcgaagttggtgtggtcgaggtgggcatgggaggccgtctagatgcaacaaatatcctgaataatgtcctcgtctcggtcattacaaagataggggtagaccaccaggctttccttggatcgaccattggggagattgctcgtgagaaggcgggcatcctcaaacccggagtcccttgtgtggtagacaatacaaacagcccggaagtggtcgcaactgtgagggcccgcatacaagaactgggtattgattccttgtttgtctctcctgcaacggtctccgaacaaatcccggcactcgcaccttacttccagaagtttgatctagagcctcaccaacaagaaaacatgtgctgcgcagtatccgcacttcgtcttgccctttctcaactacgacctgagatggatgcattctcgttgcttccatacctggccgatgtaacatggccgggccgtttgcaaaacattatcctccgatctttgatcggtcgtgcagagcctatcctgctcgacggtgcccacaatgtgcagtctgccgaagtcctcggaaagtacgttgaccgcaaaatgcgtgttcaaggccaaccggtgacttgggttgttgctgcatcaagtggaaaggacctggccggtgtgtttggttccattatccggcccggagaccgagttgccaccgccgagtttggtcccgtggatggaatgccctgggtccagccaactaacgccaaagagctcgcctcgtcccttcaagctatccaaaatattggccaagtccagagctttgaaggggatttgctccccgccattcagtgggctagccaggaggcccaaggggggcctcttgtcattgctggtagcttgtaccttgtttctgatgtgttgcgccttctccgtgcccaaaaatgataccctctatagaattgattggattccccgatctatatcagtaaataatagaattctacggcaacaacaagccttttatttcctttcccacctctcatcccttgtaataaactgcgctacgcgttaacctattgtatcctgtattcttttttggtcaaatgctaaaaaattgcaccaaactgggtattatagggctgatcggcgattgtccaacacagcctgcatgatgcggcgggtggagcacgaaagttcaaaacaaccacgatttctttgcgaacgacccctttcacgccctattgccgtctctattagatcgatatttttcagggctctccatggtgattgtattcatctgaagatcttacatgcgcctcgatttgtcgtggaaacggctctctagggcgtgagagctgaagtgctgtaatgttcacttggtgagaccctccccacaacgtccgcacgcgaacgctcattcgtgatgcttgtttgtgcattgatagactcggactaattgccaataatgattgccagaacctgtggacatgacctctgagaccgttgctctcagcacttctaaggttgcctccttcctcggctttcaccccaccccccgcctccatctaaaaccgcatcgtgagaccgacagccaactcgaacacgtattaggatacggtcgatcctagtccgctgcatcatggttgctcgacccggcgaagggagcgaagggcagcctcgccctctcaccccctcctcgagaacccccggaacaccgataaagccgcgattgacacgagtcggaacgagtccgacaaagcgagaagagaaaccgaaggaagataaagttttgaagtcgtcggcaaaagatgttgcagagcttaaggactatgtatggatataacgccctgttttcccgcaaacatggattgggcagatgctgaccttgggtgttgatgttagcaactgggagactgcctaggcaaaggagctttcggttccgtgtaccgcgcgttgaattggaatactggggagactgtcgccgtcaagcaaatcaagttgacggaccttcccaagagtgaattgcgcgttattatggtatgggattaaaccaatctcggcgttcatctgatgtgctaacacgcgacgcaacagcttgaaattgacctactcaaaaatctcgatgtgagacaccccgtcaagacatatcaaaccctgtactgatataaatccttgcagcaccccaacattgtgaagtaccatggatttgtgaagtccgctgaaactttgaacatcattctcgagtatgtgttacccggcccaaattcaacggaacatggcattgatggtttataggtattgcgaaaatggttcgttgcattcgattgcgaagaactttggtcgtttccctgagaaccttgtgggactttatatgtcccaggttcttcacggtctactctatttgcacgaacagggtgttattcaccgagatatcaagggtgcgaacattctgaccacaaaggaagggctcgtcaagcttgcagatttcggtgtggcgagtcggaccacaggcttgagtgaatcaagcgtggttggtacgccgtactggatggcgcccgaagtaatcgagctttcaggcgcaacaacagcttccgatatctggagtttagggtgcactgtcatcgagctactcgagggaaagcctccttatcataacatgcagcccatgccagcattatttcgtattgtaaacgatgatcaccctccattttcccagggtgcctcgccggtatgtcttttttggtttctcaggcatatgtataaaacgctgaccttatctaggccgtgaaagactttctcatgcaatgtttccaaaaagatcccaaccttcgagtctcggcaagaaagttgcttaaacatccgtggattgtcaatgcgcgcagaaccgaatctgtcatccccaagaagtctacagaatatgaggaagctgtcaagagtgtccaagaatggaacgaggctttgcgatcaccggagaccggaacttcaaagaaaaagcagaggccagaccatcccagtacctcaggcctgtcatctacccggaataacccattagtcgatagcctgccatccccgacctctatcaaatccacggatcgcttccgctcgcctgtgttagcaggggatgacaattgggacgatgactttgctactgcaatctctcctagcgcactcaagctgccccatctacggccacatgataactttgggggcatgctgtcttccgagagacttaaagctttcgcgtcacttgatgggactatactcaaatcggatgataattctgatccctttgaggatacctcaggcttctcagacgacgatttgcagaccattcgcccatatcccgtcaaaccttctgtagcagagccttcaaaacctcaaagctctgcagtctcccagcccggacccaatgcccccgtttctgcattgcaaaatgtcccgattctcacccaaaatcccatgccgagacgcactcgaccggctcctcgtacgaccaatctctataaagagaacactgtcgacgattattcagatctcattatggccaacgaggatgaactagatcgaaaactgggtggttatcaggtacagtccttggcaagacttcgagttccatgtgtgattctaacgttttttaggattttgaggatgacccctcgtcgcccattcatgaaaacataggatacaaccaagtagatgatgaatttggtggcccgcatccccagctgcgcaagcagctttctgtgaagcgcgaccgctctaccattgagatccagaggtttgccgagaatgaaaatgatgaggacttctctgatatccttggcgccggtcaagctgctttggataaggcagagagcgaagatggctcagatcaaagcacattgatgctaaactcgaagctgtctaactcatggctaggagaccaagaagacgaggatgacccctttgcgcaattggaagaaggctttgatgaagttgacctggaagaaaacatcgcacgcgataaatacgcacgtcttcgcaaccaggttgagggtcttgtggactctctcaagacatctcaagacgaagaagttcttgcggagatttctgaacaattgttcacgattttctgtgacctcccagagactaaaaacatcatcatcagtgctcacggtatgctgccaattctcgagattcttgacaccactcgccggcgtgatatcgtcttctgtctgttgagggttgtcaacgcaatcatctacgatgactatgaggtacaggagaacctttgcttcgtcggtggaatccctataatcaatgagtttgcgtccaagaagtacccccgcgaaattcgacttgaagctgcggctttcgtgcagcagatgtaccagacttccaccctgacactccagatgtttgtcagtgctggaggcttgaatgtccttgtcgagttcctagaggacgattacgaggacgaacgcgaactagtcttgattggcgtaaacggaatctggagtgtcttcgagttgcaagtaagtatttcaccttcgttgcactttgcactcggatctaattattttctatagggctccacccccaagaacgatttctgcagaatcttgtcccgcaattctgttcttgaccccttatctcttgttctaagtcgtgctctcgatgaagatggggagctgacagaagtcatcgagggtcgtattgccaatatcttcttcatcttctcgcaggccgagaatcatgtcaaggagatggtttctgaacgaacagtgttgcacagtaaggattatttcttccaataaacctttgcaaagttctacgctaacaatttattcaaggagtcttgaaagaattgaggcgaatgagtccagttcatcagattacgatgttgaaattcatcaaaaatctgtcgatgctttcaaccactctagattccctccagaactccaacgccatcgatgtcttaaccgatctgcttcgatcgaacctgagaaaatcccacttccgcgagctctcaaaccagatcctcaacaccatctacaatatgtgccgcctgaacaagtctcggcaagaagatgctgcattgaacggtattgtaccgcttttgcaaaagatcgtactcacagagcggccgctgaaagagtttgccctgccaattctctgtgacatggcacaatctgggaaagttggccgtagggagctgtggcgcaacaagggcctgggcttttacatctctttgctcttggatccatattggcaagtcactgctttggatgctattttcacatggtttgtctcccgtttcgatagcgtagttggtcccgaggctgacaatgaataataattaggcttcaggaagaaaccgccaaggtcgaagagcatctcttggatggtatatttgagagcgatacatttgagggccctatttcattcactgatgccattgcggaatgtttgaagctttccaaagctaacgcattcgaaaacactctcgaacctctgcaaaagcttctccgactcagtcctccagtcgcatccacctttgcgcggcccgacattttgcagagactgcggcagaagctgcaccacacaaaagccgccgtccgactcaatcttttgcgtataatcgccagcatctgcgattcaaacgaagagcaaggtgggctactcgcaacctatggtcttctcgacgctattcggaacatggagaacgaccccgcagtccttgtcagagatatggcaggcaagctcgttcgatctagcgaggcatatggcgtcagtaaacgcagaccggcagcccggcggcaaagcacgtgcactccccctccaatcttattctcggcatcatctaccccatccacaccttcttcgcaccgcgccggccagtccagaggatatctggaaggccgggacactccccggcacccacggaattctctcagtgtttcttcgcttgctatgagacctggcagtcgggatggcaacaatccggttcttggatctgccgccaatggaagcagtgcggccgctgccagacccaggtctgcccgacccctctctagtagaatgactcacgttgagctgttgcgtgaggaagacaacaagactccaagctcgctaagtcggcgaccttcaattatccctcgtcgccgccgcccgaccctcgcagactctgagtggacgtaatttgacgtccgaaagcgtctattgcgatcaaatgtttgtgttgtttcgatttctccaggtcatagtagcctttcatacacagcaacggcgttgtcaactctaaatggactttgggggtgatggtgcatggctttcctactttgtaaaacccctttgttattatgtgagcactggttgctgcacatagagtctatggtttccctttctgttcaaatcaataattctttctaatttgcacaagtgtctttttgagtaatctaatatgtacaacattgtacaataggcatatcaagggcgtatgttggtggctcgaggccagcccttgatatagtttcaaccccattctctcgttcgatacgaagttatgcttcttttggacttgtttcgctatcatatctacaggccaatcccatccttcaactgattcaacaccaatataactatgacgtctgttatgggctgatctatagatctcgggatcacgtggagcgtcgaagccgattggcggcgagaaccgtgaaaaatctctctgagccgacaaagatcatacgatgaattgagcccagaaacgcctacaagccctatcagtcccttcctcttttcttttggcttttttctctatccggtggccttcgcttcggcatgagcgcagcgcttcgcctgccgttgcgggcattcaagattgatcccgttacggtagtcgggagaacgtccaaaccctcaacacctgcatcctcgtttcttctggcttcgaactggccgctacggcaatcgccttcttccggtgtgatcaatgctccatcatggggtcgttcagtgtcctcccggggctcgaccctcgccgcttcacgccgttctttttctgagaaggcttcgcctctcttgtctccgaagactaagagccagcacaagtccgaaaatgagcccaatatgagtgcgtcgcagcgaagtatgatcaaatggtttataattggaagtatcctcggtttgggcgcagtgacgttctccgatcaagcccagcatgcattacaggcggcgaaacgcagcgggcgcgtcgttggcacattagctgtctgtatcaacgagtaagtgcactgcctctctagccccattctatgttgcgcctcgacgaaatcgctaacgcaacctcgaatcttcgcagctaccgtgttaccctgaaacaagaggcctcgtcccccgaagaacagaatgcactgattagcgcatgccacaagcgatgcgccgagcgtacactccgtgtcctggaaaagaatggatcgattttcattaaattgggccagcacctcagcagcatgggctacttgcttcccatcgaatggacatcgaccttcatcccactccaggacaaatgccccgtttcatcaattgagtcaattgccgagttgttccgcaaggacacaggccaggatattaccgagctgttcgcctcgtttgaatcgaggcccattggtgctgcatcactggctcaggtgcacattgctacgttgaaggaaaccgggcaaaaggtcgctgttaaagtccagcaccccgcgctggatgaatgggtgccgttagacttggctttgactcgattcactttctctatgctcaagcgcttcttccctgaatatgacctggaatggttgtccaaggaaatggatttctcgctaccgcaagagctggacttccgaatggaagcccagaatgctacccatgccagcgagtacttcaaagagcactccgatgctccactagtcattcctgaaggtccgtaattctgccaatgctgactttatgcgtatgatttgaaactaactagaccccagtgatgtggtcccaaaagcgtatcctggtcatggagtacatcgcaggccaccgccccgacgacctggagtacctggacgccaacaacatcgaccgtgacgaagtttccgccgctctcgcgcacgtcttcaatgagatgattttcggagacaacgccccactccactgcgatcctcacggcggcaacatcgccatccgccccaaccacacccgctcacaccccaacttcgacatcgtcctctatgaccacggactctaccgcaacatcgaccgcgacctgcgccgcaactacgccaagctgtggctagccgttattgacgcagacgtgccgcggatgcgcgagttcgcgtacaaggtcgccggcgtcacggacaagcagttcccgctctttgccagcgctattacaggtagagactacagcgttctcacaaacgaaagcgtcgtttctgcgcgaacggctaaagagaaagatgatatctcgggtgcattgggtgaaggcatgctgcaacagctggttgtcttgctaggccaagttccgcggattattcttctcatcctgaagaccaacgatctcagtatgtattcactttttgactctcaattcttttggatatcatcgactaactccctcccagctcgcagtctagacgagaaccttcacacgcgtcagggtccaatgcgctctttccttatcctcgcacgatacgctacgcgcactgtctttgaagagcagctagaaattattaaggagtctggcggtgtgttccgcaacctcttccgcttcatttgtgcctacgcgagctaccttcgcgtcgaggtcaagttgtctgtttatgagactgtgctgtcattgaagactcgcttcggcctccggagtgtttagacggtttctttttttgcggatggcttgtgcttcatatctttcctttgtttgttctgtttttccattatatcccttggttttgttttggttcattggcacggattgtcttgagtggtctgtctgtgcatcagcgatggcgttctatacttcttttcacatatggcctcttcgtctcttgcgtggattgttagagggtggattgtcctacgtttccaggtttcgttctgctatgatttttgcagaaagcaaagattctagtgtgatcttgtacaaatagatagattgtggataatttataaatcatagacttcttcttatattccaagtctacctatgtacttgatttcctctgccattcattggctttcccattctgttttagtgctcagccctcgttgcttttcctcagactcagctacgcagagtcttacctaggtaacatcccaaagtctacctaggtattctcggttattctcatgctctgctcctggtatcctagcccgggcacatcgctgcggtaccttggtgtcatttgggcgcgaagctgaggtcaagctgcctgtcgctgctcggacaggagactattttcggagagaatgataatcgcatgggatccgtttgtcgatgtattgcagccatgtctagaattgagctggtgatccataaaggcaactagcgcagagaagagagcttcacttgcactatcagacttgtgtaagagactgaaattcgatgccgctactgtctgttgaaagactaatacttccaagtctacttttacaaaagggtaactattctggtatcactgtttcattggaaactatcaaggcgctgcttttcagaaaatggagatgagagtatcgatcaaggatcccacataccgaggcgccgtcgcagaaaagaaaaaaaagaagaaacaagacgtatcgtgaaaagaaaaagggaaatatgtacatcaaagaaatgggcaacttgttcgttttcatctcgtccatcgtcatctcttggcgcacattttcagcgacatcaagtacaacgaatcccaaatgcacatcagttctcgtcaattgtccgacgagaacaagcatccttgatcaaatgattgtgtattaagacaacctcggaattaaaatcgcagagttcgtgaaacgaaacgagtgagttgcgtcattccgacagcatcacaccgtcaaaggagaaacgaatttaagcagcaggactggtggtagtctcaaccgtaacatcaggaatgacgccgcccgtcccagagagatcagtggcacgggtgttggggttcttggtgtagtagttggcaatagcagacttgatagcgtcctcagcgagcatagagcagtgcactaagaatatgttagcatgtgaaccgatcaaaaccatcacgggggggcatacgcttgacagggggcagacacaactccttcgccacatcggtgttcttaatctttccagcctcgtcgagggtcataccgcgcacgagttcagtcaggtaactggacgaagcgatggcactaccacagccgaaggtcttgaagacgacgtcgtcgatacggccggagtccttgttcacgcggatctgcaacttcatgacatcgccacaggcgggcgcgccgacgagaccggtaccgacatcctggtcgcccttcttcatggagccgacattgcgggggttgttgtagtggtccaggaccttctcgtggtatcctctgcgctgttgggctggggcgggagcagcacggcggatggcgggttgagcggactgcaggccggcgaggggagaaagggtgctgcgagtggcgatggagccgacgcggggagcaacggtgactaggcgcttgaacattgttggattattatgatggggtatcgttgatgttggatttgttttgagaggtgatgtgttgaaggcgaaaaaagatggatctgatagggagaaagtgatgaattcataaataatctgatcgggtcttagataagcacgctagtcctaatggggtagtctctttggccggatccgccggtcgtcggagattacaaagatgacgttcttttatttctttcggtcttctcgaatttgatatttcagtgagagggggaaaagttggggatttatctctctatgccagtgataatgcgtgctggtgatatcagttctcaggggtggcgacctttctgcaccactcaagttctccgcggtggactcgaccggtgaacgtcttgtttcccgcccctctctaagccaattgttgggcaatgatatcaaattgtggagagaagtgataggcatagaaagacaacccgggcgatcaattatcagtccgatatttgctgtatttcgaccattcgaatacaatatatgtttatcgagctattactacatttgcgtatctaaataatacagagagaggccttgttcccgcggagttacattcggagacaaagtcggagtataattccccttctcggcttattccaatcgggatattcattcccgaatgaggaagaaagtacatgcgtacgaggctaaatatatctatcctcggcattgttcaaacatgggccatttgctagtcaagggttatatatagcaaagtccattcacgaattgggccttttttgtccttttctaatgtctacccatgagaaggggcaggaaatatccatgtaaccagacatctaaaagattacctgaggagaccaccggaatggactgcctgaaaagaccaccaggctacggctacggccgcataagcagccgactatccttgtatgatacaactatgaaagtctcccatcctacggatagaacagaaacacttggcaaaatcaaggcatctagatgcagagtcgctttcattcaatatatcagacgacaaatctcgacccaacccaaagctaaacactacatcgatatgcaaattacaaagcctcacgaacagcagacttgaactaaaccaggcgacaaattagccaagagcaaagaagaccaaacggataacataccgggataatctgcgcattctccatatcccacacaccagaagtggtatagatatcattgttaagtagctcaagcacctgagcctcattctccgcaacagcaagcatcatgcttcccttgaaagagggtgtctcgccatcagcggggtgagcattgagcattgcgcctgagaagagacgatccatgtcagtatatgtacgtgcgcttgaaggactttccacggcactatctagacaaggaaaacacaataaaagtaaatgagacacgtaccaccggcaacaatagcaccactcgcaacgttaggcttaacaccctcgaggtgcttactgaacacacattagcaagacgaacttcccactacgcacgtcccatccggactctagatgccaggaaagactcacgggcgaacctcgagacgcttggcctgcgcgccgggcttatcgggcaggatgcagaggaactctttcttggcaggggcggaagacatattgcgggattggaaggttaggattgattttcttgattttctggggattgtagtcgaggctgaggagaataagtgtgatggcgggacgcggaggaatgattgccgcgcgtgggggaaagcgggggctttgctttgaagggcgcgggtgagatggagtgacattgtgaagggaatgaaggaaatagaatgaaaaccaattgatttggattggggtttctgtccaagtgtataaagtatgtgcaaggtacatgcgatgtataccgaacttttttttccctagggggcctttcctatttgagcttttatgatagccctggaggctcaatgagtatgtcagcaccggcatgattatgggtcacgtgcatgatatctagctggatagaggatgtaggaggtcgaaggaggttgaggctcagcaaggcggatagcttcattcgtgaaatactagagcatacggcctgtgtgtttgcagggaatggaatcgtgcaattgattatatacatgaaccccagcaggtaggccacagcacgggtatctgccttgcttcatctgcaagaaatctagactcatcacacagcatctggatttcaactgagttggtctgatatcctgcctctcatctcaaaaagccagtcaaagacgccagctcagcatatgacaaaatgaaaaaagatgaaatggaaaggacaatttgggaaatgacctgcgtagcagaatcagaatcagaatcaaatagaggaaacaagaaaaagacacatagaagacggcccggttctccctaatgtaggttttgcgcagatgatcgagatggaactcgagtgtacatgcccggatatacacatccccataagggatgtgtgtcccaatacaaagtatatcaaggcctggagaaccggcgaactgtatagacctgcgaacccgccaaacaacattttcccccgtagcgccaaggtaacaaatacacacactccctagaacgcggcacgaagatactgtattagggaagtcattaggcttcccgtcgcgaaacatccatccaagaaaaagaagaaaaaggaaaagaaaatgcgtcggaagtgaaagaagtgaaatgggccgtggttagaagctgtcccagatggtaatcatgagaagacaacacacgggcggtagggagactggtggatgttcggacggggtgggatcaaagatcaacttgatcccaagcgagatttccggcggacggaatgcagaaactagaacgctttacggtctccaaggttgccgggcttctcgtcggtatcaatgtgccacaccacgtagttgggcagtccaaccacctggtagccagctcgcttggccatgcgggcgaaaccttcggtctcggcttggttctcgaaggcgtatgcggggaagttaatgccggagcggtgcacgtcggccttgacgaggatgttgacaccaccaattccgtcaagctccacctcatcgtccttgttgttccgccagtcgcccatgccgaccaagtaggtgcggccagtgtcgtactctttgtagccctcggccagaacggtgtcggtaggcagactcgcgcggagacggcggcccttgtcggattcgatccatgaattgtagtcaactaggagtgaagatgtcagcaatctgcatagcacataggatgtcacgggtatacatacagcgaccctcgatgtcatggccatcctggttataacggtggaaccaaatgtctaaaagaaatcagtcagccagctgtccaaattccgatccaaattccatgcaaaatcacatacttggaacgaggatatccttatcgtgggccatgaagtcctccaggatacgctcgggacagtcggtaatgtccacgtcgcgccagtacacccaggagtgatcggccttcagagcggagtagaggaggtaattccgggcacgggcgatagccttgcgtcgtggaccctgtgcggcgaacgagtgtcgctccgccacagtcatctcaacgtcggcaccgaagtccttctggataatggttgcgctgcggaagcgaactttctcctcggcgtggttttggatgcgatcgagttcggaggcgaggttggcgagggtgtcgtccttgcagtcaccaacaaggaaggccagatcgatcaaatcgtgtgggtaggaaagtttgtaaaggaggtcgaagtatttggccaggtaaggagcggcatcacgaagaggggtcaggatgagtacacgttcgcggttgagagcggccttggaggtggacttgatggggttcaggtcgagatcggtgatagtggtggagttgacttcgtagggttcgtggcggttaaagaggacgggggtctgggcgtgggcactccattcgaccatctcgttaatggacatctccatgggtgacttgttcgagccatagcagtagaagctgtttgggcgctgcgtcagtatggaagagtctccggaggggtgcgcgttctctcacctttgcatctcagatgcagacctgctgacaccgcgccacatgaggatgagcagacccgtcaaggctatggataccaagaaacgagtccgtgttaataaaacgaggattgccctccatggcggcaatctggccttggccgatttccaattaacaccaccctttggcagcagcatgatgagaggtaatgtgagttgtgtagaattccaggggcgatcccgtctcgaacactcgtaaaaaccccccgaacgaatgtagagaagaggaggatcgagagtggtgaagcgaagggttatgttgtagggagaaaacaagaagggaatcgggggaaatgcgattgccaagaacgaagaacggctgaattcagttaagacaactacatctctctggcattttgctattttgctatattctgagtataattgttactacatatgtaaacattagatctattccattattctactatcctactggaatcaaataatatcggatgattcacctgggcaccagtctgacagccgagaccctttttccttatttttatttatagcctcgtctagaacctcacttagggggctattggatattaccagtatgactatatcaccattattttctacctaattttctgctagttggaccgagtacgaagtactaagtagagagtactttgctctgtaacccctattattcacacctgtagccacgttagccacttttctgcagggattgcgtgtacctactttcacaccatctttagtatgtaaacttgtatttatatttcgcccttcttttcctttttttttaccttccctggaatcccatccattccaaattagtcacaaagtacaaaaagaaagcagttgaaaattactgggatctccaacacgaggctaaagtgagacacgggacccaacccatattgtatatgtgtacagatggaggatgttgtatatagacacctctatttccacacttcaaaccacaactagcataattttgaactgctaaagaaaaaaaatcaatccaacctccgaaatctcatccaaactcgggaaacacttggccgtttcacaatgtctggactggtctccacctagcctgaggcctttgatcgacagctgattcgtccttgaagaaatctcttatgatatcgcttggaaactgttcgcattctgatgtcgtaggcccagtatccgaagaatgttgaagaaatgactgtatgtttatacgatccaccgaaaaggagggggggggatatatcttgaccagcctaaacaatgtatatcgtggtctaatgtagagcgagcgattatatatatctacagtgtgcagactatcaacatggaatccatcatttgctaaatggctgtattgtgattaatgaacacatcatactttaaccactccacggccggagggaaagctttatacagcaaagctcaacgcgtgctacaatctaccgacattactactgtgatcctacagaggaacatcattttcatcaagcattgagtcgtaactatagacatagaaaagaagaaaagtgacaaaggacaaaggaaataaggaaaaagtcaaaagcaaaatatatccacccggaaacaatatatccatatcataaacgccaaaggacagagaagaaaaagaagaaaaggaggaaaaagaagaaaaggcaccgtgtttgtccaagaaagaaagaagaaaagaaaaagatgaaaggaaactccgcaacaaaatcaatcaacaaaggaaaaggattcaagcaaatggggaacctcatgttcatccccgagatcaaaagcaaatattgttacacaatgcaggcgctaaatgcacatggagcgggaagatggaccaagccaaatcccccgagagtaagggagaacagccacagctgcaagggcctcatatgaaaaggaggatgcagcacagacagaaaagtagactcgtgatatcatcaggaaacagtgttcaatattggggcgtgcatcgtcaatgtgtaccgcgacttcatggagacacaatggtggagtggcgacgagacggcgcagggaaggagaaagacgaagactgggaaggagggaaggcaggagaagaaggaacagtcatcggcggagtgggagtgagataggaactgccaaaggactgcgaggtagaactaggcatggagtcatagtagggagcagcgtaggaagactcggagggcatgctagcagcgatctcatcgcaaagaactcgcatgccaggtaggccgttcttcttctggcgtttgtgttcggggaactcgaggacggggccggggctggtgctctcagacttgggggagcggaacatctgctcgtaggacttgagctggaactcaagggcgcggttacggtcagcgaggatctcgttctcggccttagtggccttgagctgttgctgggccgtctggttttgttgctgtagggagctgactagctgctgcagctgcatgcagcgcacctggggctgcagcttctctgagagctgcggtgtgacctgttcctggcggataaggtggacaataatggcaagcatgaagtcaattaggtagatggctccttgcacgatgtgttccttggattgagtaaggctcttggaagggttccagcctgcacgctcaaggaagaaatcgtggatgcggctgtctaactggcggtgcagctcgctgaggttgctgcggcggttgccctcggcgatgcggtgcttctcgcgctggtcatcttcattagattgtgcgctgcccttgcgcttacggccgcagagctgctggagaggcgccttgcggttgaggttctgtggggccactaaagccatgatctcgctctgagacagatcattgggccaatcgaccgagttggacttttgcatggcaaatgactcttgccaggagccttcggcagagttggccggcgaagggggtgtgacgatgtgctccgcagctgcccagggcgacttgaattggaaagtgtcctggggccctggggtagtaggaacaagggcgtccttcacgttgaagggactgaaaggaccgcggggtggcggaggcaaaatttgaggaagaggaggcagtcggcgctcctcaccaacatcagaggcagtcatactggtgctggagctaagagaactttgaatatatgttagggcatgcaggccgataccaggaaagtgaggcaactcacggcagagagcaccggcgggagatatcatcagtagtagaacccatttcttcatacatcgtagttggtcgttgagaaatgcgtgatatgtgcagtgacgagtgtgtcggaagtgattcaaagtatgtcgagaggatatatactgaaagatcacgggtgattcgtgttcttgtgcagattcgggtcgatgagtcgtagattgaatggcgggaagagtgcagataaaacagaagttgtatatgcacagtaatggacaaagtgggcagggctatagacagaatagaaaagaagcagaatcgaaaactacacgaggcgagtgtatacaatgaaacaatggatagaaagggataccatgagggctggggtgcatgtttatatgtcgattgggatggtactttgttccttattcccagattccacctctccggacccaggcgaggggaaccatgtaccagggccgatcctcgacagacatgaagcgcggaatttcggatgtcatacagacagagtgtgcatttccttgccccacagcttcatcacgacggggaagcaagacgggcatcccgggggtgctctggaccacttgctagtgcccgcttgggcccgggaagaagcgccagagaagaaaataattatattcggaattacagagggtatctgtcacatcatgcacagaccgaacctcacataccaatctgttagatcgacgaatgagggggatacgatcaagaccgagagagaggttcatgatgatccaggacccctaatttgtcaccgaactgttgggtgtcgcgatcgacacggggaagattttagtttttttttttagaggcattagggcccttgcatcaataattatcccaattaatgacgttgaaggttgtgtaaacctccgcagaactcatttggctgcgaactgttcgtggggatgaagccaaaaagagggagaaaaagaaaaagaaaaagaaaaagaaaagcactgaacaactaaggtttacttgcatattccacagtatctacgtacatcgccggccatgtccgtactcatcaaatccccacttagattccccaatagatgatgaaacgctcgctgtaacacaagctcagcatgcatttcgatatcctgcatcgatagtcaggagaaacttctatggtcgtgctatactatcaaggggttactcattaccaacgagctaatacccctcgaggcgcttctggtaaatttaaaatttccctaaagtaaatagcatcaagcaaggactgaagtgtcttgatagatgcgaggagctaggcatcaataagaatcaggatcatagttccatataatgaagtgcgaataattggtccacgagcaggaagccataagcgccattgacagttccagcgttaggattgacggcaagtatcattagattggtattcgtctaagcgaatcatcgtaatagtgtcagaaacgacatgatcgaggaaaccagcgagttgggacgagaccccaagaccagggtaaggttcctgtcaggcagcgaatcattagaattagaatgatttggaataagttgacacacagacgttagaaagttgacatatcacattacgtaggtaaagaaatactatattactatatctataatattaactagtgaagccctaaaaaccctaaagatgcacacgttccccgagtggagatagccctatgttgagtctttctttctttattttgcatgtcccttaatctccaaaatatcaaataccctactccgtacgtgcatttaattagatactcatccctggctctttccctgtccctagaagaaccaatggtggtggaaatagagctgtcatattgtgccttcccgtgtcaaccaacagtcaatcagcgtgcctcatggcgactccatccaagacactagtccccacgttctggccgttcgtattcacaatccctattattctactccgtatgttgtactccgtattattctgttattctattatttattgccatgacaaagacccacataaattatgtgcaattctatgcattctactccgtactctgtacgcgagctctacacagagataacctcacctgaatgccccctctttcgtgcattgcagactccaatctgaaactcaattcccaggtttccctgtttccagcatatgcacgcgatcggtggctcacactaaattccacacgcctctgagctatctgcagatggcacgtaccagcaataactcgaggggaaactcactcacgaaccattcgagttcggtcaaactctatacatgattgatccgagagtcccccggaccaatctggaccctgaatagcaatattgaaatctttgggtttcagagatcagagaatagactctggccccgatccctggggccgattctgagggtatcagcgtgggcgcatctaccccataggttacgaggtcgatcgtacctcgcatttcctgtatgaatgccggctgtgtgttcttacggctgtactccctgaatggtccgatgatcatactttcgcccctctttccatacacggcattcgctacaaccttggaagctcggacaggatccccgtcccgtgcggctctcaattgtaaggaataaccgtatacggagtacaatttatgagtatccaatctcccgggtcttctttgcctccacgctgtcattgtaaagcttacagtactctgagcgcccaataaacgtcaccaatggcctcctccctctaaatcattctcaatagtcgccttcccgtgccgccccctgacctgtcaagtttcaactgtcagcgacggggcggggacagtctaattgcggaaatcttattcgaacactatgtattagtgcagatgcgaataacttgactatttgatgatttgagatactaactggaatacttttcggggctgatccttgctacgcgcttaggaacgcctcatgcacgatgcaagatcatcttcgttatttttacttactacttcgtatgcctgtatgcagaaagatgaccaggatcagggattgtaggataatatacccacacgggtctcgagtccatggtacgtgattcgatcagtttcgtcaagtgcaatatcgacctgtctcgctttctggggagaagatctttttttaatcttcgattattattgtcatactccctgtttccacttcaaatcgcccctctcgaattccgtacctacagtgcactactgcgcgtgttgtctccacattggagcgtctagaatttcccgctcgttctactggagtggcgagcacagaaatgcagactcgtgtcagactgatcccacgaaggaaggggctgtgtatcatcttagcctattcgataaagagagctatttgcatgaattgatgagcactgtacagaataccctccccgcccaacagcgttgatagacaataattgtccacctcatacataaggacttttaatatcgaagacggcattagcagcaagggcagacgatcataactgtttctcaaaagccatgtggatctcaatcctagcttcgcgctggacaaagtacaatatcatcttgtaaagtccattgctgattgcccaaataggcagcgagcatctaccgttcagaagtacgtgggagaaaaaaggtcccaaacaacaacaaaagtccaaagttctcaaatccccaatcccaagaacgaacatgccgaaactctctaatcagtgtgggcaggaataaattccccgactggcgcagtcgccaccggctcctgcaaggacaacttcttagtatacagatctagcagacgctcgcggtgcatagtacatatgttgcatggactatttctggaactcaaattcgctgcatctgagaggtcacactcgagggacgcctccgcggtgcacgcatgcatccacatacagcagacatatgctcccccgtggagttcgcgatcgaagcaacatagatactgagtggagttctgtacaacgtaccttttccctctcgttctgttcgtagggatcgtctaggtcgcctggatctggttcctacatggtgcattgccgcaccgattcgcactacggtgcgctcagggcctctgccatttcccattacctggatcgccagttgcctccaatgcaaggcggatgtatatcctggtcggccagacctgaagatttgcatgtttattcaggtccggagtactgagaatccttgtttttattatttttatttctcgtttcggcgacatgcatcatattcgtgcgatttgagtatgagatggcaaagatacagaagcggagttcactgtgggataactccttaccactttgacattgccctgcatattataacaaagtctccacggttagtccgtaatctcgaatgccagctcatttcttgcgctcctctccactttttcagttcttacgtgctgtgtccgggcgggcctgtaggcaagaggagaacattacctacataccacgatggtggttcctcgtattctgctccagtttttgtcttttctcaaggaagaaaagagggtcgatgtccactctcggtgccgtcagaccccacgaagggtctatcttggcagttccccgttcgcatcaaatgccgatgtagatcagggcactaaaaagctgcccaaagtacgagtacgtacaatatacagtatacaacgtctatgaacttcgatacttctatccaatcaggtcatgatcggtgctgctcggctcacattcatggaagatcccgcgaaagtatatttcgcccttatatatccacgattttgacactgagagatcagaatggctgctaatgcttgaaggttttcatacaagggacccgaaactcacagaaacgaaaagaacagaataataaataaataaataagaaaaatagaaagacaccataggcggatcgttatagccgcttcctgttcccaaccctcactgcctttctctttgattctatacagtgatggctctatattctgtcttgtgggttccagctatgcaggcacggtctggagccgatgtaggtcgacacatacggtaatagatgcgagcactcatccaataccccctccacagtcgtcaccactactctatccgatatactatttcgtattagtctaaatggctggattgtctgttccctgtttttcaggacttggagttcgtccctcaagataaggctctagcgaccgtagggctaatgcacagtgatcttcagagcgtaaagatcgccaaatcccctctcccagccacctggatccagctctctgcatgcatatttagtcgcaattaactatgtcgtaatcactagaaccattatcttgtaggcacactgccgtagacgaatatctcaatatacaatatatattccataataattcaatatctactccgtacgtaagtagcatatatataacaatacccaaatccttctatgattggccagtctatcacaacgctcaacgttccagccaccccatatcctctccggataaaggaaccaactaatccgaccaatcacgctatgatttacattcattccccatttcaagctagttacgatcctgatctttcgccttcgggaggggccttcgaatcggattgagcgacgcggcccggcgcggtggattcgacttatcgagttttcccgataatctggattggctcttgactccatttttttggttgtttcggatattttgatgcaagtcgcaggatgatcctgagacgcacatggtagctttactaccgagtatggaggtagccctatattgtggcacgtactatcatcgtatccctagcatgtacgatggttatcttttgacacgtacaacatgacctacctactccgtacttggggagatatttacatcgccacgtagaatagtggtttacgttctccatcgccattgtcttcttgacactatgtagtataactaactctctctggttgactctcaaactaagtcacagtcggggaccaacaatcgcacacatcccgccttacgaaccccgaagatggaacccaacacccattcagtggacgatagggtcccgggaatgactttcctagctccctcccgtcttcagccccctctgcgcggtctagtcccccaatccatgttccttgtctcgatattccatgacccattgaatgccactaaggcacctagtagctagtccggccaaggaagaaaaagaacaacgcatacacttcatccacatggattcgttctacccagatcctgtgtctagcgtctagcgcttactgcatacccaccgggatccactgtctttgtggctggtcagatatgtcctcggattgatgggctttagtggtgggtagtaggtatgtagctagagacgatgtaggtaatatgctgtacttgatacacggggaagttgtgtgtggattgcggatgtgaaggtgggtgctgtgttcgactttcccgtgcgggatttggaaatggagcaggctagattcatgggtctttgcggagatttgactttatggatctggtagaagttgatctgtgtctaagtatcttggaggttagagttgacgcttaagggttgaacatggcgtggctttgttatgagacggcattcgtggatatatctcttgtcgggaagaggcaaacctgcaaagtggttaacgcttcgggctttggtggagtatgggaagccggacgactaatccatggatgtgtctagactatattgacgagcggcagccaagtctgcgaaaacgaatgtctatgggatatgccgaggttcaacgggtcaaagggacgtcgctggctcttccagactaccatgactatagatgtgcaccaagggagctacatttctcgagaacgaatgtcccaggtaaaaagaaaaattaacaattacaatcattatctcgcacgcaactagaataaaagacaatgttacggcattaaaaaagctcaaggaatgtttacacaagaagtacaacgagaaccaagaacccacccacaagcccaaagcagcctcccctcttggtacatcaacagggaacgagcagggtgcaaaatgcaacctaatgcattaggatgtgatgagggaatactggaacatagcaagacaatcaacacacaaaggatgagaaggacccccggggatgcgtctcccgaggtcagaatccgtattgcgaattttctccacgaaagaccgaattattatcgtaacaactgcaatgtggaacgaatattgagctcgttgcttggtagacttttgtacaaaaaaatccccaaggtcatttgaatcctccaccaatcaaccccttacagaagctgggcaagggcaccgaagagagcggcgaggccgacgacggggacgttggcgccggtcatgaaggcagcaccttcgctggtctcggaagaggagtcagagctggaggtgccagatccgcccttggaagtggtggggttggcgttggtggcatcacacttgaagctacccttgatgacatcgtcgttcttcagcttgcggagatcgtcacagctgaagttgccgcgagtgctctgcatgttgaagctaccctcgacatccttgagagcaccaagagaaagcctattcactgttagtatctatgcgaagaccaagatatgggaccaaggacacttacttgttgaaggtaccgctgaagtcaatggcaccgttgacacgctgcagcgcgggcaggctgatggtggagagcttgtcatcgcgggcaatggtgaatccaccatcaacggtcttcaggacgggcatgctgatgttggagagctcggagttgtccttgaagaccaagtcaccggtctgggtcaggttgggagcggagaaggtctcgaacttggtaccccagaagccgagctgaccggtgagcttctcgagggaaggcagagagacagaggagatgttctggaaggtcatgttggtaccggtgcccaagttggggaggtcgacctcgagggtatcgtagttacccgagaagctgatcagatcggtggcgttctggaggttgttgatgttgatggtcctcagatcacggttgttctggatgctgaaggtaccgacggtcttgagagtgataccgttgaggtcattcagaccagtgttggcgatgctgacatcaccagccttagtgacacccttggtgaaggagagggactggagcttaggaagggcctcccagttgatggaaccaacggagtcgagctgggggaagtcgaggagggtcagggtggtgagtccctccaagtcgaaggccttgccgaccgtggtgagagagtcagcgctgatggagctgacgttcgcgccaccggagcaaaccagaccaccggtgatcttcttgacaccgctgagctggagcatgccgctgtaggactcgtcaatcttgacatcaccctcgatggtggagcaggagttgatgccgtcggcatcgctctgggtcttgatcttggtatcaccgcagtcggctgtagaatgacactgttagtgggtgtaccgataatgccaggaacagaatactcacaggcagcgaaaacagcctggctggcagccaggacagggaggatgtacttgagagacatggtagattctaaaccacgagatgtcagcgacgaattttgatcggatttttcaatcaggggtggtgaatgtaccgattagagatatggaaaagctagaggaaaattcgcaatgagtgattagagaagaagcgcttcaaaacgagagagggaagcggaaatactgcgaaaaggcaggaactctcaaaatggggtaagaacgaatggacgaaggttggaggagagcgaaatgaagaggaaggagccttggggcgaggaaaggggaggtggagattgtttgtattctaatcttaccaggtgccactttttcactttatgtatatggcgataccaagggggagaaacacacacagtaccgcatccggcatgtcaccgtgtccagggcagtgccaggtattttaacaccggtttcatactatttcaccactgttaactagaattaccagaattaccagaacactgaaaattaccctcaattaccaaaaaaggaaaaatagaaaaacagaaaaatctcaaaaagctaattaaaaactctcaattcttaaataattccagaccaaccttggaattccctgcttttcagcgctagttcccctttctccatttggttattttgtttactcggtaattcatgattcactatttccatggatgcggaattggagttcacattttgatatgtattgtttacggagtacggagtaatgaaatataggttcatcactttcaaattaggctatgcactcggcaaggtaccctgtacaaattgcaactgatcaggcctcggcatcgtatgaatgatacgtatgtaggtatttgccacagtagattctgtacaaccatacggagtactacaacatatactctttatggagtacaaattcgcagtcttgtagcttcgcttcggtctatcaaaagtacgcaactatcctcggtgtctccgacaacaaaaatcccatgcaaatttatgcccttcgagagcatacagcgttgatacagcaggacctaataagaatgcataaatactagcttgtaacgaaggtccaatcctactagtataatttgacggatcaatcagaagtccactaaccgatttatggccccatcctatcggctgttgtcgtcatcgacggaaccaagctcgagactcgagactcctgttgatcttcagtcttcagttgtacctttgtttctcattggatattactgcatctatatgagacgacacccaacccctatagctattattatacaatatacatcgcaatcgctcaatccttctaacactacggtgtaccggagtactccgtacatatatcaccaattctcccgaagcgctaaacacgcaatgttcaaactttttccaagcttctcactttgatagtggctgatctaaatttgcgggaacccaagccttctatggacccgcctccctgctgccgctatcgtcgattgcccgacatgtgcgacttctgattggcgcattggaattactcgccctggctcactgtcaatcctcgctgtttcccgaaaatacagctctacctgaggcgaaacagtcgccccctcgcgacggcgatatgcaaatgatagcagagaaaggctattcttcagcaccaaaccatgcaattcactccactggcccctattttataggctatgcgcacagcaattggtactagaggtaatttaactatcggagatgaaggtcgatcacaagaacttcgccacacttcctatttgtacccgactagacacataatttcactaggtatacatgcacctgccttgcctatattttacgatatatatagtacagatttaaatcgcaatgatgcagctccaagatgatctcaacgactcgttcatctgaaattttcaattacaacgtaccgacaaatgaaaatttcaaggtctgtgcgttttttggtaacaatgcagaacctataacttcaatgtttggccggcacatctgtagacatctcgatggagctggtcaactaaggcacgacgatcaagcatgtctagagcttcatcggcccaccaaatgtttgatggagattccctcgcatctcgttcttcaagacccaatgggattgacagtgttaaccagtgaaaaactatttactctgaacaactgacatcccatttggggtggcaacaaagtcattattgtcggagacgttacattgtaaagtcgggaaatgtttcagaacggagccaacttagtcgatacgtctcaccccactcatgtatcggtccactaatatgctttttttctttttcgatcgcttagaaacctatcaaagactcggttcattcagatgttatatatattctaccctcgactatggagaatggccgcgttgtcttgcagcaagacccaagttcttccaaatcgcaaaaactcaacatccgctaagcttgaaccttgatacatacttgcccgtgctccttacgccacaaatatggataccgcgacatatttagcctagctctgtgttggaactaaaatagccatctgtcacagtacgaaagaacatgtgtacgaggtacggtgatttcagtgtcgtggcattcaactcgcattccctcctgtctgcccttcatggccgacagactaaccacgcgccggaatgcgtggaacgctcggcaacgggtgtatgcctaactaggggtcgcgaagggccacattccctagcacacgagactatgattgaaaagtaaacatacacaattcgctcgcccgaccactctggggtatgtgtttatatcctaatccggattttatcttggtgcagactggggctgcaatgcgaggcttttcttctagttctcatggtctgttgatttttggggctagtggtcgcacaaacaaggattcactcttgtttcaaaccgatgcacgaacgtcttcggggatttgactcggcccaacgcttcggtctaaatgctaatctctgtttttactggtcgatctgtaattgtattagacgaaccgccgattcgtttccacttttctttttttaatttccttctttgttcgcccggatataacaatcggtcggtgactgggtcaatatatacccgtaggacactagagtgagaacccgagtcctccaggtaatatcaatatagtctaacaatacttctaatacgaaatcacaccgacaaattaactacatccatgttcgatcgttcaagtctttgtccaattcccatgtgaagtctgtattgtattacggagttaccatggatcttcaatttcggtccacggggcgttctttgcggatagtgccaatgttccctggaactgtattacagcggagtatatcgcatccaattgtgtgactttccagtatagatccaaggtacaatcgtcctcataatcgtgccaagcccaccaacacactggtgggcttggcatgattactacgttttttcaaacctgatttgttgatggttaccttatggatacatattttagcgacagtctacattatcattgacacataccatagattttattggttcaactagcccttggaattggttttaaacatccatggattgtacctaggtaactacctaggtaggtacttcatacatctatacatatgtatacattgagatttttctggaaccttcatcaacgtaagtcatagagcttcttgcaatataaaaccgaataatagaagtatcaatgaaccttaacgaaaccatgcagtccacatgacgcgccaaaacacatgcaattatcttctcgcaggtcaagccaagtcataatgagcacatcatgctcattaacagaattttgattctcgagaagttcgagctacgtggataccatagagatgttatatagtgtcctcggcacaacatttcgcttccatgcaatatcaaacaaagatattcagcaacaggtgctcacaatatgaggtacagcagaagctgcgctagggcgcgctcttcacggcagcgcatatgtacaacttatgtatgctgcagacggtccatgatggctacgttaacccgagacgggtaaaccgacattgatgaggattcgagtctgccttacaccattacgctaattgacaataaatcggctgccggaaaaaaagaagaaaaaaaaaagcctatcttgcacgctggcttttggaagcccccagctctagatccctggagatttcaaccttggaaagttttccgcaatattaatcattacaacatcaagtgcgaataatatactttcgatcaccaaacacctgcagtcctgctctcccgcgcctcacggccgaggtcgtcttaaactgcttccaaggttaatgatcggctcgtccttctctcagtccacggctatgcaggatcagtgatgacctgcttttagtccgttcgtagctctagacgaaaatgataaaccatctgttttccagagcctggttcctaatgtcgaactggtcccaacaagaccactacgccaactgttatgtttaaaatgtcaggtcatcaatttataacctcactctttgggttactcacccacctacagacggagtacacacccttgcactccggtaatttccgagatctaggttgtatggtttaccagagcgggacactattctgtagtacctactatctttattatatgagctggagaagatgcgaccctgacccttgggataccgaatgcctagctagcacgtctgttacaacctgcccctggactggcgagttacacactaggccaaaagaccactatatctgagcgttacgctcagatattccaggctccgatatatatagtgcgtgtcgtgacaacgtcgctcatttaaatagtctctttgggaaatcaagatgatcatcgtcttcacctgcaaaatcgtatgtcagaaatcatttagcccactaatagggtatgcaagtcattcatctgatatagcatctccatgtaaatgctgtgcgcttgtatattatcactgccgcgtcgtacattagcaaacctgaccaaagattaaggcacttaaggttctcattgggaggcgaccacaaagggctcccagtctgaccggactgattcttcatggtctaccaccttattggattggattgcgagtgtgactatataaccatgaccaggctctggacatgtataacgtggttaatgcaaatggccctggttgataagtgcccttttgcttagaggagagggactgaaaatattccaatattccgtgcatcgaaagtgcctcacaagtatgcataagaaaaatgaaatcaatcattatatcgagaatgcgctcgtcgatatagttgtccataagcgtcattgcttggcactcgtggggctccaactccgcacctccgcaaaccccagcttcccatacgaccccctcgagacttcctcggattcagtacactgaccattgaaattggactatcccatatactacccaagaatgtcactcagacgctcagcccgactgggttctatcccaaccatcaagacaccattactgcaaagctcagctccgaacgaagcaaccagagtccaaaacagcgcagtgacaaaaccccgcaaggcgcccacaaagtccaagaaattagttaaagaacccacaaagacaaaagcaaacacaggaacctcctattggtccccagagccggcagtcacagagaaacaagaaacagacaaccagccctcaaccactaatcccgcgatattcagacctcagacaccccctcccctcgaccgccctgttgacccgcaccgaacaaatgcaaccctaatcacccctcacggctcaacagtaaacgcctacccagcgcacgcagaagatgcctccccctcgaaaactggccttccacgcccaacggccacaacagggacgctactcgagaaagccactgcgcacctcatagcgatggacccacgcatcgcaacagtaatcgagcggaatccatgtccgctcttctcgcctgccggcttagcagaggaaatcgacccctttaacagcctgaccagcagcatcatcggccagcaagtctctggtgcagcagcaaagtctatcaggaacaagttcctggcactgtttgatttacccgataccgttgcgccggatgggcatagacatgcaaagttcccgacaccagatcaggtcgccaagtgtgatatcgctaccctgcgcacggcggggctgtcgcagcgcaaggcggagtatatccagggccttgcggagaagtttgccagtggagagcttggggcaaggatgttggcgcgggctactgatgaagaactttttgagaagcttattgctgttcgtggattggggaggtggtcggttgagatgtttgctatgtttgcgctcaagcgcattgacgtgttttctactggagatttgggagtacagtaagttcatttcttgctgttgttccgtacaaattcttggacttgtggcctgacacctttgtagacgaggctgtgctgcctttatgggtcgtgatgtgagcaaactcaagggcaagggtggtggtaagttcaaatatatggccgaaaaggatatgctggaacttgctgccaagtttgcaccgtacaggtacgtgtgaccctgttcatggtgtagacaacgtgcttacctcgttgatccaggagtctatttatgtggtatatgtggcggattgaggatgttgatgtgactattcttggtggttaaaggtcgtagatgtactacctccgcgagtcaggctgcccgcataccgtgtggtttattggacgttgagcatttgagataatgttgtggtatatatgtcgccgtagtagatagttaatatttggaagtgaattgtggatctgtcttcgcagccgctagaagaggggttataatcgaagatgttatacatgcgcagccagaagttgggcgcctaacgcccaaagcgatcagctgagctgccataacccgcataagctacctaggtaggggtcccgaacagacccagtcactactaaaggttacgaggcaataagaaggcaggacctgcctgtcttgtcggttacaagattgaccaaagatataagcgcgcgaagaaaatcgatttgtacagtatcagtacactcaggctgcgtaaccaagccatgggtcgccgatgacggcgaccattcaattacgaagaaagcacaccaggcgtttatccaatgacaataacaatgctaccccaacccccctgttttcatattctattgaatcaagcagcaacggcttacttgcgaacaacaaggttgtcaaggtcagcacgctccttagcctccttctcgacctcgcggatgatggggctcaggtactcgacgtcctgtttgattcgcattgttagcattgtgttcgttgtggtgagtagatatccccaaacgaagtcggggtggaaatgacaaatcggtgcaacaggattggccgatggagacccatgcggggagcgcgaaatttggatgttggggactcacctcagagggcttggtctgctcgtgggcgggaaggagagtgtgggagatggagcactgcaattgacatattggttaggtttcgcgccagtcgaatacgggggaaggggccagtcgaacctggaaagcacggcggatacggaagacacggtcataggcctccttggcgggaagacgcttgatggccttctggacattctcgctctcctcagggatcaagtcatcgaacctagttgtgaagttagcaggtgtttctgtccaaccctgccacgaacgatatccgaaagaccggggctccaggcaaattcgacgcaaccgcgatcccattcaaaagatgtgccaccggtgcgcgacgaattcgaccagccaattcccagcattgtctcaatcgctcttggtcgggatgttatcgatataggagggcaagaattacttgagtccgagtctcctgtagccggcggcatcggtgtaccagtgggagaggggggtgagccagctcttgagccatgggcgcttgacgatgtaactggcgagcgaaggggcagacattttgaatcccgggtatcccaattgacgtgggtgtggtggagggttgaaaggctatccgactggaacacgagatgacccgatgttgcgaggttgtgcaaaacggagctcgggcgactaggcccgaaacggcagctctacgcctgaggccagaagcacgtgacaatttcgtgcctcaggcggcagagaaactgggaatgtctatcggcgcactccactgagcagatgggtttcctatgtcatatccccttttcgatcttatcgcttgctttgacagaaattggatttgctaattgctgaagcaactactgatccctgctcacggcaagaagcttgattgttctgagaaccccgcccacgtccgtgctgcaagatattagcacattgcgcattcaaaccaaccactccgggttcggcaaccatcggccccaaaaaactctcactctctccttcgtctttacttaggactttttacttacgccatctacggaccttgggctttggatatttggataaatctacatttctttcccagctcggtttgaaatagggttcttgggttccggatcgagcacccgatatgctcgtgtccgggagccctcgttgattcagtacggttcgacaagctgcgtgagcgccggccaccaagatgactacaaacggccgaagcgctccaagcagctcccaaaaccaaactcaatcaatccatgtcgacaattcccccaacgtgcccgccgcaccgatctctgatttaaaaacccgcctcgagatcttttccaccaagatacccaacttctacatagcacctttctgcggagccagcgctggcgtggcctctggtattgtcacatgtcctcttgatgtcatcaaaacgaagcttcaagcccagggcggctttcggcggggagcaaaggaagttgcctcgggggtgctgtatcgcggcatgctcggtagtggaaggagaatttggcgggaagatggaattcgcggtctctatcaaggtctaggtccaatgttgctgggatatctccccacctgggctgtctacctagcagtctatgaccggagtcgtgaatatttccatgacaagacaggtaggtacctccagaccgaaggatccggtcatccatcagtactgactaagtacaggaagctggtggttatcccgcggctatgcttcaatcacagccggtgcatgctcaacggttgtaacgaaccccatttgggtcatcaagaccaggctcatgtcacaaagccttaaacaaaacagcgaaggagtacgagccccttggcaatactcggggacatgggatgctgctcgcaagatgtatcaaatcgagggcattcgctccttctactctggcctcaccccggctctgctgggactgacccatgtggctattcaattccctctctacgaatatttaaagatggcgttcacaggctatagtatcggtgagcaccccgataccggtagctcacactgggtgggaatatccgttgccactttcctcagcaaggtctgtgcaagcacagtcacatatcctcacgaggtcttgcggacccgactccaaacacagcaacggactgttccggcacaatctcacgaagagattgcattccgcggcggattgaaccatccacatgaccgcggccggtcgggtggcatgtcctcatcagatggaatgcgcggccgcccacgctatagtggcatggtacgcaccttccagacaatcctcaaggaagagggatggcgtgcattttactccggaatcggcgtaaacctgttccgggccgttccggctgccatgacgactatgctcacctacgaatacctgcggaagcagatcaataccttgcagcatgaaggtgcgcataagatcaagatggaagaagaagctcatggatctatttgatacccacaatatatcagcatacaagagactatctccaatctccaacctcacccttcatatctgcttcttctaaaacatcgcaccccaccgcttctgatcgccgaatctttcttttcctttcgtcacaacctgtatagacatggacgaggtggtctgtgactcggtatttgcagatgaatcttttgcgagtaaattttggctactgcattctgagcgcatacaagggtctcggcataggtgacagtgtctccagcctccaaatctctgacatgtgaaacaactttcacatgtattcacatgctcgctgcatcttatctgaagaattacttgcccttccttattgatttctaaacttgtctaccgtctttctggcttctgcatgtgtttcctgtatatacatcacttgttctgcatgctcgccctttctcgtgaatacacatttcgaataaagcaatggctttcagatcttatctggaaagacgcacatatctcaattggaaaggataccttgaatgggagggataacttatatatgccaaaacactgggccttggaggccggctttcaacttgatgctgatataggttgtatagaatgtagttgaacatatggggcagtcacgtgacacgctatttaaaactgcccgcgattattttttccctctttcttttccgcttctttcttcatcactttttttttttttcatcaatcagtacttgttcctcaaggtgtttaatgctggcactttgaggatcaattcacagatcagtctcagatattgatttttgtcaggttcacttactaaccactttcaactgccccccaggtgcctgggcaacctgactgcatcaaactaataaccccccattcgcttttgtggccatttgattcattggtctattgaaaggcaggatgtgtctgtccagtcttatgtcatcccttgtatacagtcctacaacctgcgatacccttggcctcatcacatattccttcactattcgcatgatgaacaatttcaagattgaactgggttgtcaatacacttagactcctggggcatgatcattcatacactgaaaattctgattgaatatgaagacgcagatgttactgccagttggttctgctttcctttcaccttctatattagcaacaaagagtctcaaatgaacaaagaattagtacatgttggtgtcacaaattatctatcaaacactgttgtagtggattcaatccatattatatacatgaggaaagacaccttgcagcatagactgcacctcaaggtcgtcccttcccatcgttctgcgctcgactctcttcaagtgcttgttgaacccaggactcgtctttcctctcagatggtgtagctcgctgataagaactggggccttggatttgagcatctcgccgtgcagtacggatggagctaaagcagtatgaacaaaggatgacagccattgtaaaagctgcaataggagcattgagggactagaccaagatcggtacatcagtacgtggaacaaatggagaattagtcaaaagaatcaagtctgttttgattggtctttgaaatgcattgtacatacccctcttggcttgcctaatgctttaggattctgactctgttgggtcatcgcggtgactttgatctaagcttaagctatcctcaaaggaagctatcctcaggttcacctttgccggcctaactaaacagaggcaaacttctctccacaaagggcacacttgagcagaattaaaaattattgagagaagaacacgcataagcgacctcgggaggaataggccaggatgacaaaagtgctggttcaacttgaaaagtggggaggcggagagttgagcggagagataaaagccttatcgcgttaatcgatgccgacgttctcaggccgtcgacacaccttgggagactctttcttaccaaacaaccatggcttctgatccccctccaaaaaggggcatgtccctctatgccaatttacttgacccgtctactgatgcgcctggtaccatctcccgtgcacctgttgtttttaagcagccggagactgaatctcaacccgacgacgcggccgccaaaaagcaacaactgaaccctggtatttacccttagcttgttggatactccggagcggcacattctgaccttcacatttcttcatagcttctcttcggttccaaccacccaaaagaccacagctctcagcccagaaacctaaaccgagacatactttaccaaaggcaatgtctcaaccacagccctccgccaaccaagcttcggtgccgacaaagagcactttggctgattggaccgccgttgacgatgatgggtatgagtacacgcgcgagaagcgacagcgcggtggaagaaagaaacgcaagaagaactttgaaacacaagttgcccaaaactgggacgatatctacgacccttctcgaccgaccaattatgcggaataccgccatagtgatgagcagattgctgaaatccgcgagtggaaggatctcttgtatgcgcataccagaaggcgttcaccgagcagatattccgacggcgaggatgatgaccggccaaggaagagtatgttcctgtcttttgcgattagtgatgatgcccagactaaaaagataccacaggacaatttgcgcctccgagcaactttgcgccgccgccgaatcttaacgatgtgccaccaccagcttctatccccaatgacccatccggtgaggatgcatttgctcgccgcgcagcattaggggaactcccgtcacccgcagcccgaactggagataatactccaattcccgatgatcccactggcgatgatgcgtatatgcgccacttccagaaagccgagaatccaccatcaggacaagtcataccacctcctccaccctcacgtccccttgatgccatccaacctagctccgcaactatctcccgtgcaccggtccggtacgctcttcccccgcccccagaaggcatcccggccaccgaaaccgaacttgaagctgtattggcccaagagcaaccggcggatgagggggagccagatgagtccgcgccgcgatcccttcgtccggggcaacaaggcttcgcagaacgactactttctaagtatggctggactaagggttctggcctcggcgctactggttctggtatggtaaagcccctggaagtcaagattgagaagcgaaagaagcgaccagattcagagggcggtgggtttatcactcccgctggacgaggtaagatcatcggaagcaataagaagggtgaatatgagaccagcaagtttggccctatgagccaagttgtcatcctacagggcatgctgcaaggcatggacctggatgcggagatagagcgaagtgatggtggtggtttggtccaggagattggaggggagtgtaacgaaaaggtgtgtttcttttcatcgattggcttggggggcttttgctaactttaggggctcacagtatggaaccgtggagcgagtcttcattgctcgcgacgtgggaaccccagtccctgtctttgtcaaatttagggaccccttgtctggtctacgggtaagcctttaggatctacagcttgattcaagtttggggttgtgcattgctgaccattgcatatacataggccgtgaacgcgctcgaaggccgggtcttcaatggtaacacaatcaccgcacgatttttcgatctcgagaagttcgaacaggggatttacacagtctaattgcccgtgtccctgccatttcatgtagctatgacatctcgataatttgttcatttgtgcattctcgactattgcacatacaataggccgtgaatgtctcgaaggccaggtactgaatggcagcaaagtcatagcacagcttttttgactgaggagtttgaccgggggcttacatggccaattgcttttgttcatacccctttgatgtacttagctatgttaatgataatgttcgattttgtttgatgttgctgtagtgaactctcattgcaatgtaaatactatctctaaatgtaaaggaaaatgcaggctatgggatatctcgactgtagatcatctaatcccctaggaacctccaaaattccgatcgaaaacctccatcccattacactaatccatcaatctattgccccgacaccttcttaacaggaagtggaatccaggagcgccaagtccggcgacactttctcgacttagaagcgcgaagcaaaggctctctatctggcatatcgtcatcagtgataaacgccagataagtacgattctgcgggttgcgcaccaacctagtagggagaggaatcatagaccgccagctccgacccgtttggggctgaggctcttcatcttcatcatctgcgtaatcatcagtatgttcaaccaaagcaacacaagacaagtgaggcgaggacagttgcactagggtcggcatgtgtgccggaccactacataacgacgtacgggtctccctgttctcagctcgctgagcaaaacacctctgagtcaagtttggaaactgggagacccatgtttccatatccaattcttcagcgtcgttgtcatcgatggcccagccatcttcgtcgctatactggaatgcatggtttaacgccgatacaagatcttctctccgccattcgcggaagacacggtggcgtagcagtagctgattaatcttgcattgcacacaattccctacgagtgagaaatacaatgtgcttcggtcttctgtgcactcgtagccccttcggaaggctccgtggcatgcgattgagtagctcgcatcagggcattggtgctggcatagggcatggtaccagataattgaatgacacatgctgatagatgatggtatgtatgtagctttccaaggtcgggatttgatttgtaaattttgctgatagtttgcttgagggttggtgagtgaggatgagagtatgccagatgaaacgggaagatcttcctttatacgcctcagaccagaatcaaagtgtgttggcatctgccgacaaacttttgttgttggaaagagcctttgtcgaggatcaatccgggctcgaataaagaaccattttctcgctgcagcccttcgccgttattgttgatacagggcattgtagaccctgttgggctctttgttggcttggagaggtatatgaatgcctttgttcataattttgccggccaaggtcataagttatattttgcctagcgtagtggttggaaggaagcacatttgaaattgtaattacaagtggaatatccgggacttgggttgtatcaggtagggttgacctgaatccatagcgccgttgatatgaatatctcgatgggttatcatcagccaaatagtgaatacagctgactagcttgccatgatccaaaggggggtgcggttaacactcccctttaattaaccttggaagagattatcagcacgggtatatttcatatacaaggtcacattttttagatcaagttacaacgccctgggtatatctgtgtgctccctaaacgtagcctaagtacatacctaggtaggtaggtagtactcggtcttaataataataactaggggattgatataggatgataccagatacctgcaatttgtaggcaaacacaatgtaaaaataagtcacttttgtcagcacctctactcagcaccatacctatactagcactgtacaccgtacccagcagcgtatccagcaccatacctagcaccgaggcctaagacgcgaatgcggacgtgcaaggggccaaaaaagcgcgtctcgagggtgaaaaggatgaacaacaatatattgagtacaccaaggcttagtattgagtccaccaattcttaattcgacagaaatgtacgatttttcctgatcaaagtgcatgtctttttactatataaaccggaattcctatagtggtggcagaattatatggcagaaaactctgcacaggcagaaggcatggcagaatccccagtcgcacccgattaggaaggcagtagtgtttgatacctaattttcaggccggggggtgtggttatatcaatccccgaataatatatgctcggtgagcacccggacccgtggactcccagggttagatcaaaatgcttaggggttgcacttgtaatatatagccacatagaatatatgaaagaaagaatatctcatagaaccagttgtaattgttatttatgcctaacaatagaagtgaggctccttgggaggttcctggacaaggtcgggccggtccttagtaggtattacataagcaaggtcattccaaggttgttcgcgtggggaggtcaattgctatcacctccccggctttgacgattgccacctttagaatcttccgctcatcacctcacctctttctccccctccccttacccatcaccaactaccggtcgtcctctgcttatttgcagtcaagttgtatctttctactgcttgatcttctaccaccttctgcgaggcagcccgtttcagctactcacccgctgagcactacccaagatgtcgttgtgccagaaccgtcttcaagaagagcggtacgtacatttcttgtccagcggattccgcgattctgcgcatcgcttgcgccatacccttgccccgcgctgacctttatggtttctctagaaagcaatggcgtcgcgaccacccttttggttttgtcgcaaagccgaaacgtgccccgcagggtggccttgacctgaagaactgggaatgcgctattccaggcaaggctaacactctctgggaaggtggactcttcaaacttgacttgatcttccccgatggtgagtggcgcaacattcatgactattgaagatccttatactaatctaggttctttcacgcttctagaatatcctaccaagcctcccaaatgtatgtattcccttcgcgatataatcctgcggcaattcgccagaagagagcttctgctaggagctgtcaccatgatttcttatgacgacaaaacactaatataagaactgttcaggcaaatttacgccagcactattccatcccaatgtttacccttccggaacggtttgtctatcaattctgaatgaggaggagggttggcgacctgctatcactattaagcagcttttgcttggcatccaagatcttctggatgacccgaaccccgagtcacctgcgcaggctgaggcctacaacctcttcaagaaggaccgtcctcaatacgaacgcagggttcgcatggttgtcagggaaaaccagcccaattaggaaactagcctaatcaggctttgacttacacaagcgtaaacagcgatggcgctgcatgggtcatttacttttctttttctctctttcagcatgggatacagggaaattgtggcaagattatgcatttcttgtttaacgaagggagcaacttttgcttttctatcgcgagcatggcgttttctgggcttaaggtcattgaaaaacaatgatactgcatacatgctccctgctgggatgcttagacttgccatgtattgagttcagggtgactcagaagaaattcgatgtcgtacttatttgcttctatgcatagataagaccactcgggcagccaacacaacttccatccatgcccttcttcgcagatggaatgagcccatggtgggtgtctttggaagctggatccaacttgcacttttcatcaataagacaccaatccgggaaccttcaaaaacatcttgcaacccttgtgggccccgcatagatcttgatggcctcaatatcgagacaggtgtgtcgcctttatgataagactgacttggcttcacattccatttgatatttattatcagtttccttgaacagacatcgaggtacacttcctcgaggaagaggcttggctagggctatagttcacatggtgggggtataatagtcacgtgatggtaatcagctcattctccaggggtcgcctatgttgtatcagactgagatggacgagtatacatatgtaaatatccatggatgacccattgcaagagtcctcggatatagccgcatacctagccacagtaaagagtagtaaaacccttacttaggcagtagagaatagtccaaagggccgttatcttatcggtgactcaaaagacttgccgacatcgcccctcgcccccgccgagacggcaccggggcaaatttggaaaaaaaatcgccgttctatggttccccatataaccggacgattagtcaattccactccggaacccttcttctctctcctctttgatcttcaatcttacccacacttcttcaattgcccatcatgtgtggaattttcgcgtgccaccagttcgtcttgtcctagtcttagctccccgcgcctggtgggatgtcaatttgcagaatactaactagaagtcctacagtcaccccgatgtgcaaaagttcaagcctacggctttgcgcatggccaaggcgtgagtacctctactgtcccttcaattgcggaaatctgcaattgcaattcccgatctacaggattctcgctgacttgtccctgatcatagtgtgcgccaccgcggtcccgattggagtgagtcacaggccgagttgcaacatttcgcagtatatgtgaggatcatagggttaacaaaagtcttccaacaggtggaaacttctgcgccgagagcactagtgagttgacacgcaatgattttggtgtcggcgtggtatgctaacgcgcgattcatagtcctggctcacgagcgtctgagcatcgtcggtgttggtatgtggccccctgtgaacgaccaacaacttgaagatctatatgctaacaatatcctctcagactccggtgcccagcccctcgtcaacgatgacagcagcctcgccctcgccgtcaacggtgagatctacaaccaccgcctcattcgcaagaacctccaccacaagtacaacttcaagacgcactctgattgcgaagttatcattcccttggtatgtcacacgcgatacagcggaatcggacaaggagtctaaatgctgatatatactagtatgaggagtatggccttgatgcccctaagcaccttgatggcatgttctcttgggttctttgggataagaagcaggaccgtgttgttgctgctcgtgaccccattggtatcaccagcttctaccttggacgctcttcctccactcccggcgccgtcttctttgcctctgagctcaagtgcctgcaccccgtctgtgacaacatcattgccttccccccgggccacgtctatgattccaagaccgacagcttgacccgctacttcgagcccaagtggtgggaccccaccaacgtccccacgacccccgttgactataaggtggtccgccagagtctcgagaaggccgtccgcaagcgtctgatggctgaggttccctacggtgttttgctgtctggtggtctggactccagcttggtcgcgtctatcgcccagcgtgagaccctccgcatggccgaagcagcccgcaaagctccccagaacctgaatgccgacggtgagttggttggcattgatgacgagaacgacctgtcgactgtcaccaccttccagcagctgcactcattctccatcggccttcctggtgcccccgataccgaggctgcccttgaggttgccaagttccttggcaccaagcaccacccgttcaccttcactgttgaggacggcctcgatgctctctctgacgttatctaccacctcgagacctacgatgtgaccaccatccgtgcctctactcccatgtacctgctgtcccgtaagatcaaggccatgggtgtcaagatggttttgagtggtgagggttccgacgagatcttcggtggctacctctacttccacgccgcccccaacaaggaggagctccacaaggagaccgtccgccgtgttaagaacttgcacttggctgactgccttcgtgccaacaagtccacctccgcatggggtcttgaggctcgtgttcctttcctcgacaaggagttcctcgagacctgcatgggtgttgacccccaggacaagatgatcacccccgagcgtatcgagaagcacatgctgcgcaaggccttcgacacctccgatgagcctgaaaccgctgcctacttgcccgataaaattctctggcgccagaaggagcagttcagcgatggcgttggctacagctggattgatggcctgaaggatgaggccgagcgccaggtcaccgatgagatgatgaagaaccctaagcccgaatggggtactgacgttcccgacaccaaggaggcgtatgttttcgcttgtttctcccattttatagtactgttgaaaactaacctggggtatagatactggtaccgtaccatgttcgatgagcacttccctccttactgtgccggcactgtcgagcgctggacccctacctggtccaagcagaccgaccccagtggaaggtgagctattgcttattctattctcctatttgggtcattttctctaaccatcctttgcagagccatcgccatccacaaccagaagtatgacaaggagtaaaaagccttgagagcatataaacaaaaagatctggactttgttttctgatttagcattttcttttgggggatataacaccggattagattttatatacccttttcttttggtatatagtcggtataattgttatgatctcaatatttttactttgtattgacgtaaacacgtgacctgccctgcccaaacattgccggcgggctttcccggcagccgggcaaccgccaatcaccgacctcccactaacccgtgctaagcccctaggttccccccaacatcatcacaactcttcctttccttcctctctcttcatctcttcataaaacctcctttcctccatctctaattccactctctcgtcaatatgtctgcccccgctgctttctctgatatcgccaaggcgaccaacgatgtacgcaaaactgttgggaacaaaactcagaaccttggctaacacccgattccaatagctcctgaacaaggatttctaccacggcgctgccggttcgtctatccaccacattgcgccagtaattgaagattcaatagctgattgaaagattttagccaaccttgaggtcaagtccaaggcccccaacggtgtcaccttcaccgttaagggcaagtctgctcacgagggccccattgctggtcaggtacgttgaatataatttccgaatccgctattgcaaattactaactgttgtctatagctcgaggccaaatatgttgatgcgcccactggtaaaggccccctccacaaaaaacctcccgaccccggcgcgcacacagcccgtctcatgccattgatgtttggatgtggtgttccaatagcgcgccggacgaacctatttattttttcggatgccaaggtgcaaaggattaggctaatatgctcactccgaccaggcctcaccctcacccaggcttggaccaccgccaacgccctcgacaccaagctcgagctcgacaacaacatcgccaagggcctcaaggctgagatcctcacccagtaccagcccgctaagcagtccaagggtgccaagctcaacctgtacttcaagcagcccaacctgaacgcccgtgccttcttcgatctcctgaacggccccaccgccaacttcgacgccgttctcggccacgagggcttcctcgtcggtgctgagggtggctacgacgtcaacaaggccgccatcaccaagtactctgctgccgtcggctacagcgttgcccagtactccgctgccatcaccgccagcaacaacctgtccctcttctccgccagctactaccaccgcgtcaacgcccaggtcgaggccggtgccaaggcttcttgggactccacctccggcaacgccgtcggcctcgaggtcgccagcaagtaccgcctggacccctcttccttcgccaaggttagttttacgtccttggattgcttcttatcgctgttatggattacgactaatcgcgtgattttctcgcaatataggctaagatcaacgaccgtggtattgccgctctggcttacaacgtcctgctccgccctggtgtcaccctcggcctcggtgcttccttcgatacccagaacctgaaccaggctgcccacaaggtcggcgccagcttcaccttcgaggcttaagcgtctggattttaatcctttcagaaacctaacagatgaactaccatcttttgggaagatctttgtaaacttcaattactagttcacttgtcttgctgattcgccagaacgatgattatggtggggtttcgtccaagataataaccatgtgcgtgtgtcgtagatctttctgctcgatcaccctttgtatatcaaatccaactttttcctttgttgatcagtctgatcgattcataatatctacaaagcaccggggagtgtgctcgtagccatacaagagttagtgtacatcaaccagcaatgtatttgaacctatgtacataccaagaaactacatgtacaggtatccaaggatgtatgtgtggaacagtctagcacaactccatcaagaagacaaagcctccctctgcttcttcgtcttcttcccatcaacagccttcggaaccgaccgccaaagatccacgacaacaagcatcacaatcaaacacccggaacaaagaaagaaccttgaaatcgtctggtcaaccccaggctcacgctcaaccctctcctcctccatcctcctagcgcccctcctcctctccctcctcctccgatcctccgccgcctgtgtccggaaatgtccctgcgcattaaaatgatgcaacggattccgatgaataaacccctcccaatcctccggatcagcatgtttcgtcccagcgcccgcgccagctcgaaattccgaccccgcagcaccaccagccgcccacccctgcccctgtctccccgtgccgccgtatccaccctgctcgtagaaactaggcggcggaccacggaatgccgagcgccgcttgctcagcccgctggcgggtcgtgagccggcgtagctgctgtggctgcccatcgggcgttggtgggtgtgggtttggccgggcgaggtatgctgcgcggtatggaagccgtggtcgcggtcgtagactgcgcgcttggaggcattgccgaggacgttgtaggcggcggaaatgcgggcgaagcgttggcttgcgtctgggtctgtgcggttgcggtctgggtggtggcgcattgagagggcgtagaattgtctagggttggatatgtaagtattggagatacatgtggtttggagatgcaggggtggagggggagggagacatgttgagtgtgggtttgggcgtacttcttgatctccgctgctgatgcggttgtcgggacgtcgaggatttcgtagaagtttgcttcgcgggcttgggcggggttgctggttgagaaaagggatatatttggcctcgaggaccgctgtggatgtttgcatgggtgcaattgtggtcggaggcgttgggttgagatgctgcggtaggttgaagaggaagagagggttgcgcgtgtaaagtgaagaattgctgctactcgaggtggaggcattctatatttagagagggtgacattgaaataaacagaaaaataatagcataggtaggaggtgggtggaggggttggaagaggtagagggagagagagggagaaacggaagaagagcggaggtgaagatcggagtggcgtcactgcggttcgacgctgatcgtacaacgacaccacgtattcaatactggctattggcagattctagaggatgaaatcactccattttatctcgttcgtctattgaaatagcaacatttaatacaacttacaactataggcacgtgggcagttacaattcccatagctccctggagctgatgatcagattagataagagatatcaacctccagggctaggtaggtcacctacgctattaaccctttgatccaatgagaaccctccttcaccagcttgggataccaaaggatccacatagcgtgttaaggttccttttgtgatagaggttgcgagtgctcttcatgagcttggactcggtgatccacgtctcattgaagctggtggaattgttggtgaaagaggctgggctgcggcattcgctcttgaagcctccgggatagctatggggactcagtccctaggagccgatgagacttccattcttgactcttccgaagtgcaagatttggggcacttgatggaggggtggcaagatcgagagttttgacgagacctagagacctaatttcggcaaaatctcgcgatggtcatacctggggaatgtgggtatatgaacggtataaaagtggtcttactggtttcatctacgctccagatgctgagaatgttaatgtcaaggggatgggaagtatgccttgggcgcttagggaatcataatgaaagaaatatggcgtagcctagcagtgaaaaccaatcctattgtgcaagttcgaccctccggtctaaagtagtacctaagttatctgcgcctccgcctcttgcttattcttatgtttcggatttgcatcgatttccaacggcgcttacggcgctgggcgagagactcccgttatgtcaagaacttcactaacgaaacaaagtagcccctaaattgacatttatattgatgatgtcgtattttcatagtcgtggacaattgcttacttatctattctactcttgaaaagccgattgcacgaaaagcattgtcttgagcgcttaagagaaacttcaactggctcttgttgttatcttcaagtggacgcgacacactgaagatgaagccaaagctttctttggcagcttaagatataaaataaccggggctctgtgcctgcacgtatgtctttgtactcgctagtatccataaatagacaatgaaacgccgaagtctcctttgtaatgtatagtgttattgttatactctttgaaactaaatagatctctggatcaaagagctacgcatgaggaacacggcgctgacttgaaacactggtcttattcaacataaaacacgatacaaagcagattcccggagagcctgtataaatgctccccctaagtagccgcgagctatcagaattaaacggctcaacccaaagtgacacactgacttgattcattcttcttttccccacgcatccctttctcaacaatcaaactgtatcgaaaacatgccgactctctcagaatttcctaacgagctgctactggagatctccctccgccttgactatcctggcctcaatgcattcacacgggtctgccgccacttccatgctttgtcaaatagggtgctttatagaaccatcgccaaagactctcctgggaaagcgatagcatgggcaactaaaaaagagaaggaaaccagtgcgcggaaactgctgcagatgtgcggtatgaagatattggacgatattgtctttggacgagaaccaatagtgatcgccgcatcgaatggacacactcatcttgttgaattattcctgcctcactgcattcaccacgacaccgaaaaaggaggagatctatacaaaaaagcgcttactaaggcaattgaaaaagagcatgttgaggtcgtcaaactacttctcgaacacaagacccacaccaacagccaggacagatatgctgcaattcctttatgcagagcagtcagaatgcgacatgtaccaattgtgaggcttttacttgaacacaattactgcaacctcgatgcatatgacatgtatgacatgacgcctctagccctagctgcagcagcgaaagcatcatctacaaatctggaaatcgccaaactcttggtagaggctggcgcagactcgcatatagaacacgggctgttactcagagccgcgaaatcatacaacctccccgtcatgaagctcttactagcgaataacttcgattggcggcgactagagtggttcgatgtcttgcgtgaattctctcgaccaataccggaaaactacgaggtgggggaattactactaagcgggatgaatgtggatcgcatactgagttatggtaacgctcaacgctgctttctgttgaggggagcgattgccaatcatctcgatgatctgctagaaaagatactgaatgagtggcctgtcctcgatgaaaaccataagccaagccggagggcaatccgtttctgtcctctgagtctggctgtctgcaatggccgacctagcgccgtcaagctcttactcgagcatggcgctgaccctggtggtgaacttgactgtccaccggtacaatttgctcttgaacaaggaaaggatgcaatggcaaagctactatttgacaaaggagcgacatttgacccggaaacgtgtcatgagtcgtccggataccgtcgattactgaagctccgtatggctcgagtgcagagagtggcctattaataaagacctatagttatctacatgatatggagattgtatattgtatcgaaacacaaacttacttgtttacattttatacacacctaaggctatagaattcttactttccttcgtacatctacctcgtagtttggcttaatggctaattttgctgtgttagctcagatagacatcgacctagctagattcaagcccaagtcctatttaacaagcgacttggatgcggagagcccgatacatgacaatatagctattcttagtaggtaatatcacgctttaccctaccactcctacttccttttcttataacttcagaagggaaaaataacagactgttgttttggagtagctccggtacgcggacgcggacatctgcggacaaagacattatgtgaaaccctgctagcttctccataattgctggcggacctcacatttgtgagccaatactacttgggtacgcagaacccacttagtctaatgagagacgcggtctatgccgccaaatcttatttgcgctttttctggctagagatcgacgccgcggttttcggcagtcgagcaccatgccccgctgcgtttgggagtggagatcattcaccctagcgttctatcttggccaaacatatcttagagcctaaatttggtttctccaatgcagtatacggtctttctaatcacaatctcctgatggcaactatatagacgctatggcggtggcgatccatggtccgccattgtgctcccagtcggttttggaaagatagacgtatagggcaaaaagagagattggatctacaacatagtacttacaaggaaaaacaccccatatggtggagcatcagatgcagtgcagtccgcttaaacctaattcaggagcagtaccctagggaatcccattcttatagccattctcatacaaacatgatccctccttctgcagaggattttcaagatcccctcacagagttcctggagccctgaatcatggttctactcacccatgtcttgcgttccctatacgctgatggcggcgaggactctatcgcccaccgctgggagttccaggaggagagtccccttcgaggtgtcgaccggtcgctctttattgctatgggaatccttgctctctgctcattatgttccactctgggtctactgtcgttccttacttatcgattcatctactggcagcggtactacaaaaactcgcttgcgcagaaccaatatgtcgttctcatttacaatctattgctgatcgatctacaacaggctatcgcttttacgatcagtctatattgggtggcccggggcagtattcactctggtgaagtggcctgctatttgcagggctggtggattcaaacagcagatcccggtagtggtctgtttgtcttgtctattgctctgcacacaggctttgtcgtcttgcgtggtcggcagctgcctttcaatatcttcgtatcctgtgtggttggtttgtggatgttcattcttcttttgggattcattccggtcggcctctatggatccaacgtctttgtcatttccgaagccaactgggtctgtctccgttcctgtgatgataggatggcgatgatgaatttgactaacttaatagtatagtgctggttgagtccacaatacgaagatgagcgcctctggggccactatatctggatcttcctctccgagtttggcaccattgttctctacacgatcatgttcttctacctccgacgtcgtatgcaacaagcgaccatgctccgccgtggccagcaggacagtctgcgtcgattgaaccgtgtcgtcatctacatggttatctaccccttggtgtacctgattctgtccttgcccctcgcagcgggtcgtatggccactgcgcgaggcgactctcccagcaaggcctacttcggtgtcgctggttgtctgatggctttttccggtgctatggatgtggttgtctacactctgacccgtcgtcacctgctcctcgataccgagcacagcaccactgaccatagctacggcaacaccgactcccaatggcaaacgaatatcaccaccaatgctggctcccggtctcgaaaggccttccggataggatctcgtctgaactcgaaaatgcgccgcagcgtgcccgacaaagaccacaccagtcccttcgaaggctccaccgaggacatcgttgggaagaatgatatggagatgtcgaacctccacggtgtgtaccaggagaccacgattgagatttctcatgagccagtctctgtcatagagtcggaggagaggagcgcgcgtcgcagcggctaagacttttggatatgtcgcatgccttattctgtatattatattgttgtacttacttctcaggcaccccttgccacaggatatctttctctcattatccgatatatttaatgatctgcagtatcccgcttctgtagaactagacgagacgataccatagatctgcgaactgtcaggattccctgatcgatcttacggacacacccattaggagacccgaagaccgacagcaaaattccgctaattgcacagaattttcccaggccagagttgttcaacgcagtcagatccgaaaaaacatgtggagtagcacaatttacagatttatgcgagccaagagccaagctagggccgggcccgcaaggcttctttttcttaaccgttgcttcttttcagtctggagttagaaaaagaaaagttatacatctcttactttttcccttcaaccatctgaatgataactcacgttatgtcttatggatacgtaggattaaccataaatctcctccatcagtggaaaactgtcgccgagtatccgttatgatatcgttggaccacttcccggcgtattcgaaattttctcgaactataactcagtggatacaggcgaaaaaacataggcaactataaaaaaaaatcaaaataaacaaacttataggacatgggtaaagaaatccaatcttttcccgcatatgggaatacactagactcgctgagtcgatcggaagaactctttgccgttgaagcgtacggtggtaaaagctagttcagtccatcaggatattcaggagactgtggatgggtctccgactaatcatgtccctcggaggtagtcccaaatgtgcaatggtcgctgcttagccgagccggtggaggtgagtctttctagcgcctgggctagaatctgtcggaaaaagccgtcatctcctatgttgtagaaaagggatctggattgtgtgttcggcccaacttggtatgttgtagatcctcatctccgcagatgactctgacccacattcccgatttgattccctatttgaatagctccgtagaagatgataggatggaagtgaagcaattggcacctttcaccattgccgggcgaaatgaaaaagaacatggaaaaggagaaagaaaggaaaaaccactctgaacatttcgccagtccgttggataagccagaataacaccgggacaaccctaaacatgtgaaagaggtccaataactccaacatggctcgaggagaatgccccagggaatcgaattgaactataaccggccaaataacacgttcctagctagactaatgtaccctaaaaatttacacataaccttttaagcatctagagttctcgattatagctccccgggcatatcgtcattaaagcttgcggccattgttgagacctcaacgactcgagtgctttgagcgggccaggattgggagtggaaaaagagtacggaacatgaacatcttaaataaattgacgctgattagggccatcaaaaagtagttcagcaatgaatagtattgttaggccgagtgctcactaaatgcctctagccaaactccgagtaccgaatacggagcaatcagtgagcagcccaatcaccgtgactgactctgagcaccatcataaaagcggcggcagctataatagggaagccccggcagaggaaatcaaatatgtatagtgacctaggtactcaattctctattcgctcgcagggtaagccttgcgccaatagtaattccagagtgtcctttgtatggctaaagagggcatggccttccacccagtgatgttatgattagcgccagaaggagccatcgctgccaatatatgagacctgatggtactgatcggaacgtcttgaccaacatatttcagcagcatcttaaccgttccgatatcatttttccacgaagccacggccaaggcagaccctgaacttccgttgcaaaagagaggatcggccgcggtcagtaacattgaatctacatagtagctcatattgctcttcgcccgtgtcgctcttagcaattttcttgatggaatattctgtatccctaacaatgtttctggctactcccgagaccgtgaagagcaaaggcgtgtaattgtgaaagctgactggctggtcgagccgtgccccgcgttctagcaaaagattaactgcagcttgcgcggcatcgcgatctttagcctgagctgcgagacagaggagtgtacaacctctatcttcttcatcgagttcgaatcgtgatccgagtttggcttgcgcatccggattaaaacccgcatctaagaacatattcaagataggcgcattagctagcatagcagcatatgtaaatacgcgggaatgtccaatgcgatccggttgtagttctactcctcgctggaggagtaacctgaagacggcttctcctcctaataccgcgagctggattgataggccgtcatctgaaaacgaaatatcttcaatcgacggaccagaagtctcaaacagcatttggaggatttccactttccccagatagagtgctctgttgaaaaggtccttcccatgctgtgatgcaaatacaacatcaaagcccttgttaatgatgtactttacgacatcatcatggcctcggtcaagcgcgagaatcatcgaagaggggcaatcattgggatcccagcccccatatatgtcactctcaataaggattgcgggataagtcacggcgtgataaagagattcgccatgatagagcaacaactctatcattctgatattgccagatgcaacggccagagccatgatatttctatggccatggtcgcaattccagttgctaaggacagacgtcctcgttgataatagtctctccagcaaatcctcgaggccgccagctacagcaaaacacagaagtttcgaccgtgcatctggaccaaaattgattgtgtggtccaaatcaatcttctttaggaggagtgacgccaatctcttatgccgtccgtctattttaacgaccatatccagaataagttcggtatcaaaaacatagcgttcgaagacgtaattgacgaacggctcattgccggtttccaaggcaagatcgaatggcgattgcgaccaactggtgtatgtggggtcagccccagcatcgactaaaagacggactatttccatagtcgtgcttgtagctggagctggagcaacataatgcaaagtgtggttgcgaccacacataatattaggatcacagcctcctgcaagcagaagtttgatgataggaatatgcctctgcctaaccgccaagcataatgataagtcacaccactttcttttctcccagggttccatacagcgtttgataaatccacgctcaattaaaaggctgacaactgaggcatgcccctctagtacagcgacggacaatgggtttccgaaaatgacgaggttatcaagattagagggcggaaacgaaatgagccctccgtcattgatcgctagagtcgggtctcttccatggtcgaggaacattcggacaatatctacatgaccgttctttgcagctattgtcataggatcattcctctgtcggatccagcctgaatctccaaacaacgcacctgcgtctagcagcttgcgaacacatactttcttcccattcgctgcggcccacgccagaggttggagggactgctctgtcttgagcaattcgtcgactctttcttttaacaaaccaaacagaagaggatgacattgatagagagagccgagatcggaaacaaattctagataagaagttacctctagtagcagttcaaaggggagttgaagtagcgacatggcttaacagtcgacaacgacgataacgggagatgaggaataatttcagtattcgatgagagtatttatcgcaggaagcctataaaaggactcatgcataagcttcaaggttgtcatgatgagggcaacttgtcatagtccgtgtcaagaataggtctagtctacgaggtagtaactgggcagtccgctgccaagcaaatctccaggaatcgcccttatcttatcagcaaaaatctttccccgacatccgacattcccctcttttgcctttgaacgcacttgtttaattgccacattcaatatggcagctcagactacagagaagttagatcagctggactgtaagaatctcagatttttggattgcctctcccaggtgtgactgattagataccagtgaacgtccaagccgccccgacggcagaccaagttcccgctgaagcggaggaggactcggacgacgcccaagacgagggtgccgcagaggctggagctgctggaggtaagctttgttgaggtttctttctcgtgaccgcgcctccaggaccccacctcaccccacagaaatcgaccgaattgaactaacagcggggtcaactctagccgacaaaaagaagaaaaagaagaagcctaagaagaagagcaagaagaagggcggtgccaaggttcagagcgagccaccgcgcgtccccgtgtctaacctcttccccaacggccagtaccccgagggtgagatcgtcgaatacctaaacgacaatgcctaccgtaccaccaacgaagagaaacgatacctcgatcgcatgaacaatgacttcctgcaggagtaccgccagggtgctgaagttcaccgtcaagtccgccagtatgcgcagaagaacatcaagcccggccagactttgactgagatcgcggaaggtatcgaggattcagtgcgcgctctgacaggtcactcgggtctggaggaaggtgataacatcaagggtggcatgggcttcccttgcggtttgagcatcaaccattgcgctgcgcattataccccgaacgccggcaacaagatggtcctgaacgagggagacgtgatgaaggtcgacttcggtgcgcaccttaacggccgcattgtggacagtgctttcaccatgacctttgaccccgtgtacgatcctcttctcgccgccgtgaaggacgccaccaacactggtatccgggtaagttcgcctttagctttacctttttctcaagcagagctgacgggtttctaggaagcgggaattgacgtccgtatgagtgatatcggtgccgccattcaagaagctatggagagttacgaagttgagatcaatggcacgatgcaccccgtcaagtgtatccgcaacttgaacggtcataacattgaccagcacgttatccacggcggcaagagtgtgcctatcgtcaagagcaccgatcagaccaagatggaagagggtgaagtttttgctattgagactttcggtagtactggaaaaggctacgtgcgggaggaagtaagtttatactgtcactggacggagaaccgaaactaacatggtcccagatggaaacctcgcactacgctctcgccgctgatgctcctaacgttcccctgcgtctttcctccgctaagaacttgttgaatttgatcaacaagaacttcggcacccttcccttctgtcgccggtatattgaccgcctcggtcaggacaagtacctcctgggcgtaagttaacgatgcagctcacacgtgagacactgaagctgacgaatgtagttgaacaacctggtttcatctggaattgtccaggattaccctcctctttgcgatatcaagggctcatacactgcccaatatgaacatgtatgtttctattttggggtgttctccactttgattgtttactgacttgttcttttagacaattgtgttgcgcccgaatgtgaaggaggttattagccgtggcgacgactactgatttattccatagaccgtatatactaaaagcatctgaaagatccatcccattagtaatgtcttaaatagattggagagtcggagagtcccttgacatcaaaacgccgatcctgccaagcctcaagccatcaaggatgccgtgtcgccccacgtggaacaacagtcttccgactttttaaggcctctcctatccctcatggcctaaacttcgacacataccaatttcgcatcatgtctgcggtcgttgaaacaagttcaccgcacctccgggtgtcggcagccaaaacatccgaccaaacgcaaccagagtccaccagaatccaggcaccggatgctttggtcgacgaccatttcttctggacgtacactgaagaaccccatcgctcaagacgacaggcaattatcaaggcccatccggaggtacgtgaccctgttttgctggccctcatggtggtacgggggttcgatgaagattccatgcggagttcccggatacatctggccactttactgggcgacggacagcctcaacgaatgcaattgcaatgctgattcatgatattatggtctataggtcaccaagctatgtggccccgagcctcttaccaaatgggtcgtcctcggcgtcgtgtccctacaaatcacctgtgcctatctccttcgcaacacctcaatgctcgattggcggttcctggccacggcatatgtgatcggtgcgacttgcaaccagaatctgttcctcgctattcacgagatctcacacaacctggcattccggtccgctttcgccaaccgattgcttgccatattcgcaaacctccctatcggactgccctacagcgcagcattcagagtacgtatactattccagaaaccacaaactagcagaaacccaggagaagccatgaattgacaaaagaccaacagccataccacctaacacaccacaaatccctcggcgtaacaggcctcgacaccgacctccccacagcagtggaagccttcttcctaaactccctcctgggcaagacattcttctgcaccttccagattctcttctacgccgtgcgcccaatgttcatctacagcccacccttcacctacatccacctcctgaacctaggtgtccaaataagcttcgactacgccctcagccaactatgcggcaccatgcaaccagtactatatttcctgctgagctcattcctcgccggatccctgcacccctgcgcaggccacttcatcgccgagcactacttcttctcgaacgtgaagagcggcggcacagagtccctagcagagctgaagaagaacgagaagtccgagaccccgcacccgctcgactcccttcctcccccggagacatactcgtactacggcccactcaatatcctcacttacaacgtcggcttgcataacgagcaccacgatttccctgctatcccatggaccagattgcataagctgcatgagattgcgcgcgagttctacgagccgctgccttgtcaccggagctgggtctgggttatttacactttcatcttggataaggatgttggtccttggtgtcgtgtgaagcgtgaacagggtggacggattgttggtggtgggtcgaagcgcggtggtgattctgctgcgtctaagcaatggaatggacgtggtggtgagggtatctcggctgcgtcggcgggtccggcgggcgaggagggtgatgggtggaaggagagtgagattcaatgttagatcttgttcggccttttgactataacgtctggtatggaattttcagttgttcgattacatacattactgggtggagtactggtgcttgttagatatatctgttttcaataagaataggctgtcattttgcggtttttatgaggcttcaaacgtgtgcgcgtagggagcacgaagtattgatctcggtagagtcgctctcagccaaaatgctgtccggtccctgtgtctgcaagaggatcgaatgtctgcgactaactaattaccgaaggagggagacgtagtccccaactatgtacgacatggacttagctctagtagcgaccacatggattatcccgagctcgagaataggtttatgaaacaaagagaaatgaatcgagagggctaggtccgttcatcataaaatgatattagacaagacaggaagggtaaagaaacaaaggaaataaacaacaaagaggatgagacagacagatgtctggcctctatggaagttcggacatccgagagaaaacatgaaaagagtatcgatactggggcaaaaaaaatcaaagcaaacgcagaaaaaaggctgatgctagaacagatagaaaaaggcatgctcttcaagagacagaactagatgggaatttgggagaggcgtcagcgacgttagaccagaggcattgagcacacgcatagtacgcgcaatgaagctagatagaccgtgagaaagcgacaaacagaagaccagcttagaagaagaagtacgcgatcaagaaactgagaaggcagaggcatgctacaccctggatcgaaactccgccggccgttggcgcatgtgactgctgcatagtggcgggcacagccttgctggtagcctctccgccggtcttccgctgccgcagtccttggtctgcgagtcggtccttcagtcgctggatctgtgcgttggcttcggacagttgggacttgagttcgtcggttgagggaagagaattggcaacggcggacttggcatttgaaatggcagatgccggttcgcgctgaggagactgggactttttctcagagaaatcgggagcagggattggggacggttcatcggagtcgactttcttgggggccggggtctggaagtttgcgccgccaggagaagtgtacgctggaggttcctcatcatgcacctggtggaagttagatggtgtgtatggagaaatgattgctgagtagcataccgagtcgttggctggagcggcatcacttgctaggtagacaactcggatcttgcgctcaaccacatcggacttggcggtttggtcgaactgaatatagatattagtgattggtcttgttgttcgcgatcccgcagtctggacttacgatctggctaacgctggcatcctccaagccacgggcgaccgggacggcctggaccaggaacttatccttgcacttggcatccggagcagggtcctccttcatagcctgaagcaacactatcgagaagatttagcccgccgtaattcaagcgtactcggttatcaactaaccttggacttcgacagtcttgccaggctcgatgtggccggagttaggtcgcacacagtaactggaatatggtcagataacaaatctcgagtataggcattgcagcataggatggtcggggcatactgcttaggagcggtggttttgacctagcgcgccgaggacatatgttagtgctgcttgtcccgcgacaaagaccgaggggtgtcacacataccttgaagaccacggagtcctcattcgggttggtcaggcggagaacctggcatacttcatgattgaagggacctatcatcaagagatgagctgttgatctaggcaggtctgagacaggttcgggatctggcactcacgcttgaagcccaactcggagggctcgatttggatagtcatggtgcacgtggtcagagtgaaggaggtgggagaagggaacaaagatgacaagagcacagatgactgtacgcgattaggtttggattgggaaataaaggtgtgggagggttatcaggtctaagccgatgcctcaggagtttcgttattgtccacctgggcactttcggggaaattggatgagtcagcaaacagtcaggtgatgtcactattgacaagctatacatcgtaaactggaacgtttgccttcttcatttttgtttattctattagggaccttggctgggctggatattttggtcgcatgcctcattactcttcccccggcattcgcatcctcggataaacatcttcctccacctgcatgtgatctccgcggtggggtcagtcatcccacttgcccatgtttaaattgtatacgacatatgtattgcatgttatatcgttgctcgtacagcggttcctggcaatttatgctgagaataagccagtatatgcttcatttccatgggtgaattgcattgagctgtggcattgaggtatgtggccatatccctcggccacattcaagttatgctggtttcaacattgaatgtaaatggacgtcatccaacttgctaccatatatagtagattgaggcttaaatatagtacaacttgggatacctacaatgcaggtacgtacctcatagcacacgtgtttagcagagatgtcttgtagaggactatacaattctagtcgttccgcaaatgcaacatagagatttacttgacattaccaggcttttagtggcctccagatattgaaatatccctcagatgtgccaccgagaagaacttgatgccatagaaacccggggaaggctaagtgggccttatcgctcgccgcctttctgatacgtcacccactctcccactctgctcgcgagctacctcacttctgaaccacccatttgattcaatcttgacaaattacgctaattttctgagtgttttctacgcttatatttctttcacgtcccaacagtcatcatggcatcggacctggaccagctcattgaaatgggttttgacaaagagcgcgcccagctcgctgtgacgaagactggtggctgtaagtccctgccctttcctctgatatacactgtgagcaattctctgactagctaaatagtgcaaggtgcactgcagtggctcgaggacaaccaggacaagtcattggaggagataaaggcacaagctcaagaggcacaaggcgaagagggccccgcactccaaccgggcgaacaaccacgcagcttagtatgcaacgagtgtggcaagaagttccgaggccagtcgcaggccgagttccacgcatctaaatccggacatgttgatttcgctgaatctacggaggaagttgctccattgaccgaggagcagaagaagcagagactggcggagctgcgggagaagcttgcggagaagcgtgcagggctctcagaacaggacaagattgacaagaagaggaatgaggtgcgtatttctggccttggcccggagaatgactgactagggttattttgctgacttttattatcaggaaatccgaaggaagagcactaaagaaacccaagatgccaaagaggagctcgagcggaagcaacagatgaaggaggcggccaagaagaagaaggagaagcaggatgaaatcgaagccaaaaagcgcatcaaggcaaagatcgaggccgacaaggaggagcgtcgattgaaggcagagaagcagcgagctgagcgtgcaggtgtggctccttcccagcccgccgccgtcccagcacccacttcctccggcccctctacatctaagcctgcctctgcctatacggaaactcggttgcgattccagtcacccaagggtaacatcatgaagacactgcacgttgacactacgttgtttgaggttgctgccgcattgaaggaacaggatgggatcgaggtccagagcttcgtgcagaacttccccaagaaggtgtttgataatgagttcttcggagagtctttgaaggaactaggacttgtgcctagtgccagtctccttatccaatgattgatgccatacctttcttcatcccaaaggatggatagcttttacaatgaatgagaaatgagatgacactccgaaaattgcttccatatatgaatcacatccctatcaatctccaactatccttaaatagtaatgtgttttgtttactcgaatttgacttaattcatgaagctctatctttatcttatcgcgttatcgtcatgtgatgtcgcgatgagccgcgtctcggtgcctgaagacaacgcgcccgacacgccatcattacatctctaatattgaactcgacactcgttcacaacaaaacatgccagcgtgagacccaatacccaggacctggaaatcgccatatcccatggaaccgagcactgatagtgataatcccagcgttggtgaccaacatcgcggtggtgcgggatctataaggatgccgaacgatacaggagccgccacggcaaacccattcgaggaaccccaacgccgcatcagcgaatacaccgcacaggaaattgcaacactacaagcccgtcttgataagaaattggggcccgaatacatctctgcgcgacctggtgctgcggggcagaaagtgcactatctctccgcggacaaatgcatcaatcttgcaaatgaggtgtttggattcaatggctggtccagttcgattcagacgattcagattgattttgtgcgttaatattacacaatcgactacttcgaggttggttaacacttatcaggttgaggaaaatcaaaatacgggcaaaatcagcctgggactttcagttattatgagagtcaccctgagggatgggacctttcatgaggtaaacggatatcttcgatgtgtggatttttgcttggttgctgtattaactctagccctcttctaggatattggctacgggcatatcgagaactgcaagggcaaggccgcagcgtttgagaaggccaagaaagaaggcacaacagacgctttaaaacgcgcattgaggaactttggcaacgttctaggtaactgtatctatgacaaggattatgtggccaaggtgaccaaagtcaaagcaacgcctgtgaggtccccgacgtcctccgatctgccacatgccatactgactattagaatagggaagatgggatgttgaagaccttcaccgccaccctgacttcgcaccccctcctaagaaacagccgccgccacctaaacgtgaaccggaagaggatgatctaccccttcctcgtcctgtgcatcaagcaagagtcaacaatcctgggaataacgcttctttcgagggcgatggagagtttggcagtatgtgttagaaaacacaacattgaacgttggctaacggtctctaggtgacctcttcgatgaggccgattttgcggtagctgagaccgatataggcaatcctgatgagatcgtaatagacacggagatccaacgagaacagcagcgccctgcgcccacaaacggtccagcgcctcagcgaggaccgcccgctcgaccaggatttaaccccgctgttgtaacaccatcaaaaccagagcgatggaacggctcaggccaagcgggacgacctaatcccataaatgcacgacagaacccatcggctatcccgtctcccgcattacaaggtcgaccaatggccggtcaaggtcccgcgcagaatcttgcgaaccccagaccatcagcagcacagcaaacagttggtcagaatgctgcacaaagcaacatcgcccaggcaccggtcaaaaaggaaaccgggcccgggggcttccaagggaaccaggacatgaatccaccacaaggcacaccgtcaacaggtttttactccgccagagcggtggacctccttcgtgaaaatccaaactccgtcccttcgggcgcacctcaattcgatccacacgcggagagtccctccatccgcaagacggctggtgtagaccatagcaaaagcattcccattgctaggccgatgctgtctagcgcatctccggcgccacctaacaataatacacgagactttgtcaatcccgcaacagatatgcaacgcagagtcggtgctcctggcggtggaattagcagtccggtcagcagaggcccttctatctcgtcatatcgaccattgacccggcccaacattgaccaaaggaacgtttccaacccaggcatggccaaccgtggcactatgccgccccagcagaatcttaacggaaagcggcctccattgctggacgtcaccaatgctgatgccacgcccggcgcaggggtcccggcacccggtccaaacgacccaaaacggccccgagtctcagatgcagactcctctggaccttcttccgggcctcgtccaccaacccagtgatgaacatgatctgatttgtgttttgcgccctcggagagggtgcattaccgcgcaatttccaactacaagcgttcctatttcaccgaatttttttcttcttcagctctgctccacggcatcatggtatggttatcacggcggggaaatatggcaggcgtcccggagtcctcaaagcaaatggatccataggataccagcgggggaaacacatgatattggatattggtacattctttcacattggcatattttattctgtttcctaaaacggaacctgaagcatgctggacttcagaaacacactggcaagattagacaacgggcttatgttgcagaaatatcagtcatattagaaatgaatcatgaatcacctacctagcccccggcaccaaaaattgatatcatgttcgatacaaaagtacgaacaaaaaagtacgagcagaagtatgaacacggattgggacagtcgatcctcccaggcccgacgccacgacaccggtacaataaaagcaagcacaacgtctaccgggaccttctatccgcccggtcccttcggccccttcttccgccatgctcccagtgccagcgtgggagtctaagtgaacccaggaccaatcaaagaatacagcgaatatgcagaccctggcatcgaagccacgaatccacaaaaacacccgggtgttcccctatgcatggcaatcccacagcaccgggtaacaatctccactgtccgcgttgtcggtacactggagttaacgggttgatgcattagcccaaggaaaaaaggttctaagcctggtgaaaagtgccagatctatgcctgcaggacagtcatagaaaagtaaaagagcacggaattccacgaaatcccgcggaatacatcgaggatgcggcgcaatttggtgattttgcttttttctccttttctatttgtgcttattacagtacttttcttctctcctggcttgcattatgcaccctggtcaccgagtactggtcaggcgccgaggccatgagttgactgatcggcgtctattctccggtttcctgctttgccagtgcttgaaggatattgtggctctgcagtgtccgagatgagtagtggacaagggtcttgatgcttgggcgaagatgaatgccacatatcatgtcgtgaattggccatatttaaagaagaatggatatccccgttcatcgagacataggattgcttttcattgtcaaatttcactgcccatagactttattcgtgacaaaatgtcttcgattggactctgctggagctgtacgccagcagcaaatgcagttgttgtcggccttggtcttgtcctctttggttcggtcttggttgtcctatactggagagcccgtcgaggacgcaggcgtgcagtagacttgacggtttcacaagtgagagattccagtgtactttgacgttattttctaacctctctagggagacatggtcagcatccctacttggaaaagatcctatggcctggatctacagcagccctgtaggcgtcgaccgtattggttcgaaggtaattaagcttaattccacctatcgggtctatatctgactgaattcaactggaattagatgtgtagatgagaagattcgacacaagatacgcaggtataatccagcatagtgacattgatgacatgtaaaacgaggggagacagggtgccagggtataactaggattttcatacaaaaccatttatattccgcatgattcatgattcaaagcagcgtagtctagtcaaagtaaccaaagtaacccggaatcatgatatatctcgtactggaaacccctatcacactgcaagttcaacatatcacaaagcgaaaagaccagcaaagttcttacttctgtaaccaccgtgcacattacgcacctcgtgaagtggacacatgtaattgatatagaccgctacgtactttggccagaccgttatgtacttttccaccggatgtagcttcatcctccccggtcgaactcccgggctcgaacgtgccgacaacagttcctgaccgctgtacccgcagccgggggcagtgatccggacaggaaaataacgagaagaaaaggaagtattatgacaggtctattcgggtgcgaaagtcccagaacggccggaaagggggtcatgctgcccgtcgaatcatccaggttggatatacgatctcatcgatttcttgagaacttcatgtgcatcatcatcccggaagcaggttctatttcttccgagttggacttgattgtcattgcatagcctgaaacgtgtttgcttttgtagtttgatttgcgctgtgcagtgattggagtgtgatggatcatgtttacaccccttttacttgtttcttgtcataaaataataataaaaggaacttgcttttctattcatcgttatcgtaaagaataagatcacatttgtgactagattgggatcaagccttttcccctgcatagttcgcttgagaagacaatgcgcttctgcaacgtctccaggctacgtatggcctctcaaaagacggccgtgaggatgatatctatgtcaaggataacctattaccttttagatggtatatcgccttcttacggagtctcaaggttctcatttcgtcctcttgtaaactcaaacaagttcaccctgccctcatgtctgactccagagcttgtgttttcctttgctctgtgggatgaatagcctacatttacattggtgtgaaaggaaaaatattaaatgtcgttgatcaaaggttaaagtactgggtattaatcataacaaagcccgctaaacgatcattgacttttcacttttgaccatttcaacaactgaaataggaacaccattcagctaggaaaagcaaaggatctcaaagctcaaccaggccatagaagagatggaaataacatcaaagtagagaccagatagagcgggttgaggccagtagaagaagtgatccactgaaaatcagactcttgaatctggatgggttagctagcgacgagataggttgggagggaaagatctaggagccttcgctttggggggaatcgtcgcagggtcaggcatggagaacactggattcgaagcttgctgggaagctggaccatatgatccacccatggaactcggaacacggcttgcaacgttcaatgagggccgattctcagtattgaaatgctgggcagaaacggtacggacgtgggctgttggcacatcgcgcaatgtggttggctcataggcagagggcgccggaccaataacgtggggtttgtatggcgcagggccgattgtacgagcgccggctgattgaacatcctgttgcctgggaatgtttgggtggctcgcgctcagcccccgagtcgtggtctgggatcgcaccacattaggtccaataacgttagcattggaggtgatagggcctacaggtcctgcaaaaatcgaatcgttgagagtctgtggctttttcgttgcctcctttgcacgagtagcctgaatggacgcatcggatgtagtggccctctttggaacatcaagcagacgaggaactggaactgggaccacgcgctgcggttggagaggtgcggctagtttatccgaaacctgaagagtttcgaactgggagataatgtcggagcgctcactcttggttggcgagagctcgggcacacataccttgtgcgtgcgtttatccgcagaggggggtgagttagaactggaggacggtggggccggcgatcggtgcccctcaaagggggtaaggtcacgccgggcagccgaagaagcttcaacagcgttagttccttgctgagatgttgaaatatattccacaagtgcagccagattacccaatcgactttctacctccgaggatgcaggtggtgcatatgccgtagggaccaactggagcaatttagattcaagaatgcgttcaatatcactggtagttgccaattcttgagttgtacgaatgtgtctgcggagttcgcggagttcttgaacaatctgcggaccatagataccgaagccgtcaagtgcttgactctgatcattgcggcgagactgagcttctgggatcttattggtcgttatcttgggggcaatgacttcgtcaatgctcttaactggcaccgactccccgggtctctccgcaaacttgagacctgccaattctgcagtacctggactctggatggccactgtcttcaaatggtggggggttgtcgttggtgtattaatcggagagtcatccccgctgagaagatcttgagactgagctttctgcttggtttcctccttctggctatcaggagaaatcttctgcttgttgtctttggtttgagcgaccttcgggactgtcgtcttcttggcatcggggaatggcaggggcatttcggatggagcagtgcccttctttcgtggctgttcgcctggcggaaccttccactgaatttcatccgcagcgcttgcgacaactgctggataagaagactgcaaaccagtcgccatttctttcaccattttggacttggcgctttgttggacaggaacagggcgagccggtggtgggctgggtgcttccactggaggggctttatcatgtggtcgagatgatttgggtgtaccaggctgggccttgcggcttttggaagatgctgttttatcaaggggaacaacacgaggtgacggcgagggtgtttccactagataaggcccaatatgtggctgagatatcttggctgcagtagcctgggctttggaggaatggaatgatgcagtcttctcaataggaacaatacgagacggcgttgtcgctgttgccactggcgaggatgcaggcttcgaaggtagaggaatgcccgccgtcttctgcttgggtgtaacccccagaaccgccttggccttttgctcgttgggcggaatggcttcctgtgcagatgcagtcttctgcattggagcagaggggattgcatcaacaggcttcttgtacgtttcagtagctcggcgagactgaaatgaggacataaagtccccagggtcagagattctagtggcgaagttgatgctggtcaaaaagttagcatagaaattccaacaacagaagtctgattacttacgctggcggtgggcgccggggtctgctaggggtaggcgggactaagaacattgttagctgtattctttttctgtgtgcgtcaccaaaacgtactgtgaacatgctcttgggcgcgacccttaccctttcctttgcctcgtccacgtccccttcctcggtcacgagcatcgctgtcatcgttgttgcagtttagcgcagggtctagatgaatactggccgacattgtagtcgagcgagcgcgcggtcctgggcgtcctgagcgagtagagtttgcatgaagggagcctctgtgatttctcttccgttaattggcatatcttaaatgtcggagcaaatcttaccgtgtaggagcaggaggaagattagcaggtccactaggaggagggggaacaaaaccaccccgtcctctctttcccatgacaccaccaccgcgacctgcagatggagctgggtgagggtgattggcgtaggttcgcggctgacttccattggggtgcaacatggcgtgcaaattagctcggtgggactggccggaatttatgtcatcgagttcttccattccacgagtgtctccgattttagcatgcaaatctgagacggagattagcacaaagacacaaaggggcgcaggagagtttcccctttagtacgtacttgcccattcgctcaattgagctttatctctctgatcgatacgccgcttggattcgatgtcagcaagatgcgcgcgagcctgagtagtggaatcggcggtggaaatcttttcacgccgagcggttcctaggtccgcctgttggtgccgtcagttagaaaggtcagaagagaagtgagaggctagatgttaccatttgaaggatttgcatcttgcggagcttctccgctgacagctccgatgattcactcattttcctggtagtaataacggcaagcagagggtattaaacgctgttacatgacacgtcgttgtcgacgtgcccaacgggtgtgactgtggtttggttggtcaaagcacgaagagtgagcgatgagtgagtggtaatagagatcagagcgtgggagatggtgtctcccaaaagaatgtatttgcaggtcgaagtgacctgagggacgagggcgatgaagacgaaatgaggcttagaaaggcctaagcagggcccccaagggacagacgacaagagggggtactccgaggacttggctgtaaagcgaagagacagacaataagcagagttgtgcgaagcacccgaaacaagaattgtgagaaccgctgatgggttccaaacaagcgaagaagaagcgaacaaagcagggaaaagagtgggtgtagaagaaagaaaagagagcagatgggaagagggtaaataaaggaacaatcagagcctcggatcaaagacgcgacgcgtttgtgaatgtgcaagcaatggtacctctatgcttccaaggcgacttgtccgtcgcaccttccgtcgaggagttttggccttggggactgccatgtccacgtggatgcttccacgtgataatgaagccctatagatatacgtcgaagagccattgataatgatcgtgcatttttggatgcagaaagcgagcggagttgtacaagatgagaaacgaggctgaggggttgcgatgccggaatcgcaaagcgcatgtgtccagtcgttgtccgaggaggatttatttcaccgtactcggtctgactttagagtacatctatgtatacgtgcttaggcacacggtatctaccaaattacctgatacctagcttgagacattgaaatccactcctatatacacaacggcacatagcgaatgtttcgaatgagaatgctgtagcatataatacataacagctatatgttcaaagtgaatacatatgtacacggcacatggcatcaacagacttctcgggcacactgagagtataaaccgccgctatattgcttgaaaagtctctctaaggtgcactgcaactatgagcctcgccatcatctgtaaaggcgaaaattcaatgtaagcatccgtgatgagtgcagggtcaaatggccattcaatttggtccaattgcaaccgtttcgcggggcagacttacttcgaatgatcttgataaccgcctgcactacgctgacacccatcacaagcaccccaaagcaaatgcacagatacgccggaatcttctctcgtcgcttagcactgctgagtctgatgtaacagagaggagggaatatataggctagagcagcagcactggtcgcgccaatgagctcaaacacacttcccagatcacaggttatcaaggacaacaccattgaagtcaccaccagcgccgttgtgaagataacatgccgaacagtgttgtgcggctcgtcgggaaagtagtaggttgtcatgacggaacggcagacgaacgcctcaagcggcagtgtggtcagcatgttcaggccgaagcaactagtcaaagtcagtcaagaagctctatatcgaagtcaatggggatattgtacaatcgtgcgatgttgacgacgatattgtctgatggaaagttgttcaaaacgttgccctgggttttagaaccgaatgataggaaccctgcgatgcccattgctaggcacatcaccagagagattcctgtcgagtaatgtgtgacacgggtgaagcggtccagtgtcggctttttcaatgagccgtagatcagaagactgttgtggtctgtggaaattagcgattgtgatatcagtaggatttaaaggaacatacgacaaacaaaagctggaaatcattagcgggttttctaattattgctagggacagctaaaacttaccaaaagagatgacgccgacagcctggaaaaagccagcattgaaaataaggtggcttttgatctctccacgcgattcgggtgggacccgaaagccctgggtgatgacagtgacaacaataactatcatgctgaccaaagccaaggcggatgctttcgccagctagatgactgttagtctctggtaagtactaaggaaagagagagctgaccttagcgatgtctcgatacaaagacaatgggtatgaaacaactaaaacgaagataacaataacggcccggcggtctgtgaggagccacagaaaggacatatccctaagagacggaaacaaagcgcctagaacgtgtgggatggtatcgccaacgataatacagaatgcgaccatgcctccgaatgcaaatgcccactgggcaaccgagatcgcaatgagaccacctttcccgaagcaatgctgcattgtcgcctggaacgaatccgccccactcaatttggagttgatcacaatcaatcgaatggtccaatccacagtgacggtcaaggcagtcagcagcaggattccagttgccatgcctgcctgacgaagcgcgtaaggttgtccaatgattccagcaccgataatactgttggccatgttcatgaacgccattttcatcccactccgcggccgcgcatcctcgagatgctcttcggggaagaaatcgtccgatgtcgcgagtgtcacactaggcgcttcgatgtttgtaagaagaggaattgattgaccactgtggtgcgttcttgggccctggtttccatgttcatagtcctcatcctccagccatagtgtgtcgtctgggctgagagcacgctcaatggaattgcgattggggctttctggctcctcctccaggtcaaatcgcactcggttcatggtacggggtgtacggcgctttccatcggccgcaggttgagagattgaggagtggcgttcgccatttgtcgcgttatgtgaggggatcggcgacggaagaggttccgggtggaaagctaaatcatgctcctcacttgaagctggcagaagtgattgagcttcatgttcatcctggccattctgggcatacaggtgattctctgacagctcatcccctggcatcgctgaccgtgaatagttggaagtgtaacggttactttcaggccacctgggatggggcccgggccacacgtgataggctatcttatcgataaggacgtctttgatccgataagagataacaacggtttgccatgtgcacgtcacaggtactccactacgcggatgtctacgtacttacttctgaatggataactaatgacttggcgacaaatgatcagggacaaagataaatgaatggatggccgtttcttaaaagtaaaaagcacagccccacggcacaaaagagcctagtgaatgtggacaggtaaccacagtacacacaaactaacaaaggttatcaaccaggtcgtgtctcacttcttttgacatctttcaggagtcacttgaggcaaaatgtgtaatttactttagtgtattttttatatctgcgattttggtgggaatgggttgggatgagatcagagcatcaaagggccctgggtagaccatgcttatatatcttcgaggaaaccggccaaagattctgagaaatcgaaaaaaaaaaaaatcattagctatacattggaaagccatctgcacaggttacacttctttttcgcctttcttgtgatcgtgccataaatctgagaagggaaagaagatgagaagatatctaaaataggtctagaaagacatgacaagaccgcataagagccgactactcctgtctgatttatttaaatatttaaagaatggaacacaacttcgagaacgctgttagcaaaagttatcgacgccaatggttatttcaatccggaatacagtcctttcgatgagagcatacggtctttaccatcctgatcggcgatgctggatattttggatagcgaagagggagtactgtgctgggtacgtaggcacatagagaactcgaggacatacaggtacaatcacccctattgttaccactatgtcattatgactagctagaccgccaacgtaaccagctgtcctttccctcaacgagctaggtaaagaatggagagatctttgacccatttcataaacacatttttggctcgaaaagatagtgccactatccattccctgcatcaccacgccaaaaatgtctaagtctacgtttcacacctttgcgttagttgtttttgggggccgggtggtcgacatagccctagcaacggattttgtgatgattgcgaagaagtttatatcggacgggctaaatcccacatgtctatcggggacccatctttatgatatcacgcatatgtctgggccgtttctttttgggcgagaggacttgagagaaagagtcccgatctacgatagccaggaggctacaacaccgttttaccaactagatgcccgtggcgtcaaacagcacgtcatggactggattagaaacatatccggtagggtaggcgctggcgatcgcataataatcgtgttgatcggacacggtcatgcggaaaaccacgctctcacgctgtatcctcagcgtgcagaacgtgaattcctctctaaagccgagatgattgccgccctctcggtcttgccgcccaatgtccgcctcctggtcgtcaatgaggcttgttactccggttcctgggccactatagcccctgatctaggccaccagcgagatgtacgtgtcgagacagcagccacggtgggcgagaagtcctgggcatatacctcgggttccggccggaaccggtgttctcttttcggagcgacatttgtcgaggacatcaccactcaccccgaaggccaaatactccggcatcgccatcgaatagttgatgagatgctatatgttgggcctaaccaggaaacatccacaccactagtggttgcctcgacccgcgcccttttgtcacataacatgtcacacttcatactgacgccaaagattgctactgcaatcaccaatgtagcttctacgcagcatcgccatgagacccttctccggtcaagggcatccccccgcaccttctggagacgtcttcgtcgctcggttggcgtggaaggagaaccggcgcaggcgttgggaggagagagcccggtgaaagatggtaccggtaccgacatgaaggatgccgttatatcgagctacctggaagatctcggaccgctgaagagtgccattggcaattctgcccttgtagctgccagccagatcgctcttgaaggccgttttgggccttcagatctcaaagaccaggtgatagcgacgatttcttggcaggcgacccagatgcaacgagttggccagttgctggaacatctagcccagcagagactagtcacggacttggtcgacgtagaaatagccaagcaagcactagtagaccacagagaacacgtcgcgaagcccttggtggagaggtttatgaagggagataagctgaggtgtttggaaaaccccccggatgaaggccatgtcggggtgcacttcgatgaagctacaatctggctggttgacgtcttggcctataaccggctgatgtacccgcacgacttcgatctcgatcgcgtggtagaagaggtacttctgtttctagcttagtgtgtgtgtttgtacttcttgccgctcttcttccgcacaagaatgagtctacccaatccattgcttccacaaacccttgtgattgaaaaatgtcttggtgactcggtgccacgggagattcattgttagtcatatagcccagtcagacacaagtccctaatgatacggagattaccatgatgcgcgcagatgtagaacaaaccaaatggtgggtggagaactgagatacatttaaaagacgggcgaccagctctacctgtaccactagtacgccttgcgaatatccatccactcccttatgggtgcccacttgcggcatgtatgaacctgtccaactacaagcctaactatatcattattataatgatagacaggggccggcgataggtttccatgacattggatagcttgccgcagctgatcgaggcaatgatcacggtgaattctagtccaattatccggaaagattggagttgtaatagcttcttccagtttgccgtggtggtgaagatgttttgagtagtagccaatattgagttccattcagattgcgttaaggcagtggagggagtggagacgaacggtgcaatgtaatagatatgttgaatgctgcggtacggcaccacaagagaaggtggaagccaatggatcacatatgccagtctgagatgtgttgctgtcaagtcgagggtagagctcagcaacagtctccattccaaacaagttctataacaagaatcagcttttcagctgagatcatggtgcaaatacaaagctccaaacgatatgaatagtgaaagtaaaccgacctttaaggattggctgaacgcattcttaggtcaagagtcttggaagtcatgtgctcgtccatagctataaggtcatagccacctgcgcagacctacttcagcgattcctttcccgcttcaataccccaccaatcccccaatcactcattcaaatgactgccttgcgtcccaaaaagaatagtaaattggtgatgagcttcctccacaatggcacaaaagctcaacttgggtcgatccactctgcgaatccgagattcaaagttgcagcttcgcctggccgcatcagctaatttcacccagccactaaaccatggagccccccaaataccaattgacctctcacacttgccaaatgttgaaagtgtatggataacagaggcaccagagctggagttacgcttcttcatcgggggaaactggggtcagaatgaagcagcggcattcatctcgaaaatgagaggcaaactctgggatatggaggtgtgtgagagagaatatcccctaaactggaaactgaccattccttcctccagatctggtcagacctgggattctcagtcgagatcaagacgggtgcaggcgaatattgcattgacacttctggtacccactgcctcgaacttggtctgcgcagaggatggccaatacataatcacaaaaccggtcggactttacccagtatgatgaccaatccaccagacgcgtgtcctcctcccggtgtatcaatagctacattggcttcaattgatgtttggctggagtatcgctttcaagggaaggatataccgcaatcccaggatccttccgagttggaggttggtcttggacaaggatcatcggctttccccggtcctcagctgccagagacaatgacagaaatcgcgatcctacaggcggtgcatgacgaggatctccatgaggctattggatctcagttttcttgcatatctggaggtggatcagacccatcactcgaggaactcctccgactgttcgaccttggaatccaaagactggtcatttccaactcaattaaagatcccacgattagtgtctcacagcaggccacgcttaagagcctcgcagatatctctcccgcggtgttcgaccctggatatcgggatgtgagttttccatctcagtgatgaaaaccaagcactaatttcacctaggcgatgaaccagcgaggaataacaattccaataatcaccaaagccgtatcatctatgctggcaggaaacaaagatccctccacccaagctaaactagcagatttgttagagttcgctcgctcccgccacccggatgagttgatgatacagcctcaatttccaagttggggaactgcagtcctctcatcactttggagtgtcgcccagaaaactgtgctcaagacaaaacctacgaaaagacgagtttcgatgctctctgcggagtgtctatcaactggattgactggattaaacgaaaccgtgagtcgcatgcccacggaccagcaacaatccgacagcggaaattccggactgggtcgttctttccaaacaggatatcacaacgagaatgaagaaagtgacatatttctgttgaatagcgaatccgaggaccagcttttggacaatttcagcgaaacaagctttacagacattggggattcgacccaaacatcccttgacacgttactgtcaacaattgggtcctctcagacttcatacagtgatcatgatgccatgcttctctcggatcatgacgaattggcggattatccgggaaactatgtgacggattatgatccccgagaggatatggaggcatacgacacggacattataatggctgactacctttagattcttcgtatgataccttcactgtgatatatgataacacttgtttaatgatcacgatattatcgatgatattgagcattgagaagtaacgtccatttggttaatttgacgatgccgacatctggaggtattggtgtaaacgagaggccaaaaaccaaatctctactacatacatggatgaagggtcaaccaagtctactacgtatgtagcttcaactgtaattcaaaacctcagccttcaaatatgtgtctattgcaaaagattccaaaaattctctctatgaaaagcacgtggtgtgcttcgcaccactatctaacagccccaatcaacaaccttcacctcgttggccgactccgtaattattcccggctcatatgctgcaatgaactgttcgcccagtggttgggccttagggccggcatagagccggtattcatcgattatgcccgaaagtttccgtcgctgcagtttgcgtaaacagccgatgacacaagcggtgcgatccatggatgctattcgaatattaattagcagacaggctacggcatatgtcattggaaataggaaatcttaccttcccctaattacaatggacggtggtttgccacgtcgataatttttgccatgatggcatcgatatcctcatcgtttggcgcttgggcttaagagcgaacgtggccacatagatgaggttatccaaatggagatgctcacatcataggccggtaggaccgagaagttctgcaaggcaccgacatctgtgtttgaagagctaacttcacggcatttgttgacctttgtgacggatgcgtacaggaaaatttggttagtagaactcctcggctttactatatggggtctccgtcattttgctgcatggcaatgtcagccgaagagagtatgtaggatgagggaacagggaatgttacaggatgatattgacctcttccactttggagatcgaaaaggaagatagaacagaatttatagaatttctgatccggaaactgtagccttccttgaggctatatgacactcagtggtcatgggctcaattcaaacggtccgatataggtatctgcatgatgccagcagatatagtggaagatttggagtcaagtatggtgccgatattagatcctatactcgcagtgtcctatccctgtagtactgtatgtagtaggacgcttcggcggtaccatgagccataaaacggtcagacgctatagggtggtagttgtctagcaacaacgacgaagggtaaaccgtgcgccctggccagcggtgcggggtcctgtggcgtgcgtgtcgcgggatgaggccattcccgttgaagtcgagggggaatcttctttcagtcgggtgttgaacaggtcctatacattatatccccgagtggtacctaggtagttagtagtctttaccaataatagatagtaactagtaataggacgttatctcactctgtcttgtcttcgtacatgtgacatagtagaagccacgtgggagttgagagttaataccttgaacatcagcacagagtcgaagccgatgctaacggtgcaatagaaagatgagcagatgcgggcgaagaaaggtggtcatagcccaaaccaacgccaagtagatgtatgacgttaccagccctcagtcaggttgtcgtccttcaggcgactcggtataatatataatttcactttcctgctatgtttataggtagtattgagctattgggtgtagtaaatttgcagcaagagtgacgagagagaagagcgattctgattctctgagaaactgaggccactaataactagttaacgtaatccactagcgagctggccacactagcgagctggccaccctacaaaaaacgcgtccatgaattagcacttagtcaattaaactatctaccatgccaccaattcgctcccaatcctccaaagaatcaactgagcaagagggcaggatcttattagctatcaaagcttttaaaaataaagaaatctcttcaattcgtgaaactacgcgccgtttcaaaatcccccgttcaaccctttcttcacgtcttaccggaatacaacaccgcgcgaattgtcgcgtaaattcgtgtaaactaacagaaattgaagaagaatctcttcaaaaatggattctctctatagattcccggggatcagctccccggccgtctatagtacgagaaatagcgaatcttctccttgaaaagcgtggcactaccccagttctttcggtcggcgaaaattgggtgacgaagtatataaaaaggcatcctctcctatcctcccggttttcgaaacggtataactacgagcgtgcgaaatataaggatctaaaagttataaaggactagtttaatcttatttaaaaaactatcctacaatttgggatctacccggacgacgtttataactttaataagacgggttttgctataggattgatagcgactacgaaggttattacgagaagcgaatactacggtcggcgagcacttttacaacctagaaatcgtgaataggtaacggctatcgagtgtacgaatgcggctagttaggcccttccactatatctgatttttaaaggcaaagtctttattaaatcttagttcgatagtcttccttccgactagcgtttcgaagttagtcctaatagctagactactaacgaaattggacttcgctagcttaaaaagctctttattccgaccacttttatacggataaagggggtatatcggcttttaatactagatagctatagaagctatttaacaccgaggtttgataaaatttgtgaaaaaaaccgggttatactaatctatatacccccgcatttatcctatcttttacaacctctagatataggctattttgcggtattaaaacgagcctataggagactagttgaattccggatacggtacagatccaattatatagataaattggacttcctagattcctatcctaccgcacgaatagaagcttttaaactagagattgttaaaaatagcttctaatctgccggtttagtccctttcgcgctagagagagtgatttcgaagcttgatattcggcttgctacactaacccccccccccctagccggggtagtgattgggatctaaaaacaccttcaaactgtaggcaattggaaaagcaagcttcctctatcaaagtattgcttcgtacgagatcaggaagtcccctaagtccgctaaattccgctataaatcaggttttaaaagcttgtcaaatgacgatacaatccgctacacttctagagagagaagtgagtgatttacgcggtgaaaacgagaagaagaagtaaaagcgtgctagatctgggaagtatctatacgtagagagcggtctctccgtgtaggaagtatctgcgctgattacacagccggtggaagcagctgaacccggtcccggtcagcatggtgaatcaggtttacaaccgcgtacaaaacccccccgggggtgcggagtatgtaggaagccaggacataggagagagacatgtccagatagatgatgtttttttaaaaatttaatttaatggcgttttggttgagataaatggatttgaaattagtatgttggataaagtggccagctcgcatagtgtagccagctcgctagtggattacgttagttaactataactaactagttagttaacgtatttcacaagcgagccggccacacaagcgagccggccaccccacccaaaacgcgtctatatgtgatcccagaagcccagttccttatataaacatgtcttatgccttattggccggatccatatggacccgtttctgcacttatgtacactatcgttaccgtattctatagtacttagccgttagcaaagctaactcaataaaaaccatacgatcctttccgaatctcatctggtagcatatcggtataggccaccttccacggtggcctagggaggcacgagatagcaccgtatacgtctagtagggcgaaaacggtgctaaaccctctcgtcctatcccgataacgatcctacggacctagatactaggtagggaagcttataaaaccttattttctccttcctttcctctactctcccctccggctctctcggcacactagattccgagaacgagggggaagaacggaaaaatataagagataatatcctctcttagacccggagcgggtctattaataaaaaaaaaaaaaaaaaaaaaaaacgcgtaatctatagagaaatatagatttataaggacctatatagccggacagaatcttagcccctaagtgaatatatcgctctaaaggaaaccttaaatctataaacgtccgtccgagagaaataccgatctatacgggagtagaggtcccgctacctagtaaaatctatatctaggcgccgttaaaagatagacggcctcctaacctaataagaggaatatagaacttattatttacttcctctaagaaagaaaagaaccccctatcgcccccgctaggaaataataatatctacgtagccctcttaaggaaataccgaagctaaatttatagctaacctctcggtagaggttaatatagcccttaaccttctagaagtaaaggaacgaaatatcttcttatatatatattccactatagacccctagtaggttaatcccttagtcgaacgggctataaatagggcttaggccctctaggcggagcgatctaaaaccgaacggcttatagcggcctttagtatagctataaacctatcctataggttagacctcccttctaggggagaatagccgctaccgaatacctctaagaaacctctattatctatagctataatcttttaagctatagataaggatacctataagaggttcctaaacgacttataggcaattactaattataatagcgctatccttaacgacgccgcctataaatagacgcgcgactacgatcgatacttcttagagctagtaaagcttaccggttataactctcctaataaggtaaagatactatatacctctaggaagctcgtaaaggtcgcctagtagcgtctagaatagcgcgagcgataatataacttacttagtatagataacttcctaatataggctatatttaaggaatagcttaaataggaatttatagagtacctatctatagagaaactctataagcgctataaaacgcttaaataagggaactaatctatataagagtacgccgtaaatctctagtaggttatatccgaccttaattaggatattccggacctaatattaatctagcgatttgttactagtacgaaagctacctactacgctaaataggctaaaaaacgagactagcctaaaacgattaaggatattatcttctatttcgtttagtataagtaagggcgggttatcgcccggagatataaaaggtctttagcgagatacctagacgctatagatattaatactattattagctctatagaggcttatactatatagggcctactaccgtttaaagagacccgagaatattataactataggaaacgggggtacctagcccgtttctattagaagccgaagaccgaggagataaaacggaagtaaaaggcggtatataaacaatcccgctaacctataaaaaactagtatagctatataatatagaagccctcgtcggccgcctataataggctcctatactaccgttatttaatatagataatatcctcgacccttattaccctataaactcctataaacgggcctaaacggagccccctccgctatcttagtaggggcggagggaaagacccctatatctatccgcgtccttaaacgtccttactaactccctaacgttttactagggaaagatctatataggagacgccgacctaatatctatctatatactcctagatagcggagtaagcgatatattcgtctccctataggtcctcgggaagttagatagatagatctaggtataaaaacctaagaccctattactagttactatcgtaaatagcgagcggctagaaacgagtggttatactatccttctagttaaggtcggaaactagatagaatagattaaagcctagatcctcctaaccgagtacgatataatccttagccgagatttcctctaggtagaaaacctatatatcgactagcgtatatctattataacctttatagattataactattatatatacactatttaccctataaataacgcccgcgttattataagaggaagtatatactttaatataatatcggctaaataaatacgccgactcctctagaaattagggagcgaagcctacctttttatagtctatctaacttatcgcggatataagaacgaagaactagggctatctaagagcgacgaccctagaatttagcagatccttataagatataaagatcttttccgagcggaattacctaccatacttcccttagaacgtaatatagcgtataaaatcgatataggaatatatacacctattaatattaacgtgtatagactctcctccgagaagctcgataagtaagctagataaatcgaagatcttattaaaaagggcttaatccgcgagtctaatagcgtatagggcttcttagtcgttttcgcctagaaaccgaatagaaagtagcgaatatatatcgactatcgagccctaaataatataatagtaaagaatagataccccctcccgcgaatctaaaagttattagatattatcgggaatatatagatcctctctaagatcgaccttatagccggatattagtagatctatataggggagggttctatcgagaaaatagtatttaataccgtctagagaaaatacgaatagctcgctataccgtttagactatataacgcgcctactaccttctaatctatcgttaataaaacgctatagcccctctttagctataatatagtagtatatctcgataatatccttatcttcttagccacacttaataagtaccggaaatatatagaagaagtcctagcgctcttatagaagtaataactatatacgttaccgactaagtgtacgttcgcgacctaggaactagagttttatagttatatcgttagaaatagaacgatatagcctctctcggctaaagtcgaagctatataggcctagccgcgactaaaaactatctataacgtctattagttcctcggcttagctacttattactatcgatttatttataactttttaaaggtatatataccactctataagctcttaaaagaaagtgatagtacacttcgtaaataacgtttccgccctattacctagatagaagtctataaaagcgcctttcggaaggtaaaggacctccttacttccgccttagtccttaaataacccgaccggaaccgactatatattatcgaaatagataccttcgaataggccctcggtatagtccttatataggaggacgataatagaaaactctatctagtagtatataataagcggaagctatatagcgccgagctaaactaccctatatacgagaaagagttactagctattaaagaagctatctatatataggataggtatattaatagagaccggttcgagactattattattaccgataatacgtccctataatacctaaatactataagggagtatagtaagcgcctcgcgcggtagatcgccgaattctagtagtattagctatctatttaatactaaaagggctcggagaatattatagcggatactattagccgccggctagacctagtcggaactacctaagctaatataagcctcgagaggcctattagagatagatactttacgcttataacgatagtgtatagtatccctaaagaagagtagctcgcggctataatctagctcttataagatagtatagagccggaggacccgactatccaaaaggctataaagaaatataccgaccgacttagcttataaaatactaatatattcgcgcgggctcctatagaggaaaactaataactcgtttttacctataaagatagcgttatctccttatacctagatcccctatttcgctctaagctactctaaaaggcttattataagttcggctacctcggcttcctaggccttaacggtataattaggcctcggggttagtggctatcgatctaagcggatatagaggagtctataaagaattacctaaattactaggttttatagggctcctataaagacctcgaacgggaagctatataatatatagtaataagcggtatccgcctattcgagcgttagggaatcgaccttatcggccccctcctaacgataccgaataggaaccgatagattattatagcgatcgactatataactagctagccggtcgcctatatagtcctagatataactaaagagacgtttatagaatttttattccgcgatatatatatatactatagtatatttaataaactactctcggataacggtactaaccttttatcgggagccgtataacactttataagttaactaagagcctattatcgtacgataataccctactatccctatactaatagtaagatagagaattttaatagccttattagtcgtatacttataaaataccttatagataagcctataagactttaggacgaatatcttataaaagcgctattcgccgcctatatataggagcacgctatcactcgaaagagcccctacttcctagtctatagtatatatccctatattatcgcggatagaggtaagccgccggacgcctaggaaagaactaactaggataagtaaatctagtagcttatagacgcccgctcgaaggtaaacgagcttctacttatctatactatccggaaataaaagatctaagacttagtagttactaagactagctttaaggccggtaactaggtcctagtacgaaataaagtaaaatagaaatttaagagtatatagtttagtctatataaggtcgtatacgcctacctattaggaatatacacccttaccgaactaaatagacgtgttctccggaaccttattaatagtgcgaggctaacagatataaacgtcggcgataatcctagcttataggtatcgccggccggctagttagctctacgttaagccggttaaaagattagccgcctagaagaactctataaaatcctcgataaggtagaaccccctccgccgatatacacggacctctctatatttataagggaggaatagtaggaatttaggcgcttaggagcccgtatagaattcctagaggaggaagttatagctaaacgtattatcgtaaaaacgcgagtagccgcgcgtaagagatagacgaaaactattaataaggcactagagtagggcccgctaggtgctaacgagtaggatatagaagtaaacgactacaaatccgaggattttaaataggataaatccgataggtataaatcggctaaggacgcttattataagcctaaataaggcttaagccgaaccttataccctttcgtagttattattctacccctatctaaagaaatctaagagcttacggctataagaagctaggtattaaaagatttattatatttccggtaataacaccgaaggagtcgcctatagaggactagactcgaagaaaaacgaatcgtattaccggccttaggaacgccgaaggagccgcctagaaggggtaggacttaatagaaactatcgctaaaccgcgcgaatagaggtataaggccttaataaaaactaatataagtagaaagagggtataaggcccgaaaactaactataaggatccgtctaccttatctttaatagtttagaatatcactagagtccgaactaccgtcctcggacctatcaccttccgctttagtaatatcaccctcctttagctaacccttcttaagccctagatcctatatagcggtataattataccggacgcgcttacgcacttcctagagacgtttgtaaacgttatagaactatagcttatcctctatatagtagatattaggctagtctaagggagtcgcgtatattatactatcgaaagccggaccggagcggggtgtggtatatatagtattaggaggattaggtatatccttagtacgctttttcttctaactacccttatctttaccgctaggggcgttactagccgtacgtttctttatagacttagagggagtggtaatagcactaccggctttagctagactagcggaagccgggatagctttacctttacccttatccttagcgggaggtatagtaataggattaataggagccttactaggactaatagctcgtcccttctccttactagcctttttcttacctatataaggaggtctattagtataaacgagtatattcggggccttaagtaagatactatcgggctagaagcggcgaacgaggttatatatctagaacggagtcttatagttattatcgggattattagtaagatcgccgattaggcctagaagacgttagaaaagaaacgaagataaaactatccgaaaaggtacttataaagggtatatttattagccgtactagactattagtaataagtatacgataacgactactagaaacctaacctagcgaggaaaacgatccggtaaaaggaaaacggactattacctttcttataagacgcgtaagctttatttaaaggggctttatagctaattatttagcctagggctatatatatatttataaccgaggatactatatagtccttagtgatacgctaatcgactctagtacgcttagggtctatatagtactataattagtcctacgaactcttcgagagaagtataaagagaggtatcctagtagcgtctactcctttacctaaaacgaagtagttagcccttaaacgggtatagttagagtagggaaaacttactagcgtcggtttaggcctataaataaatagtagcggccgggataggaagtagaatatataactaacttctatcgccgctatagttagtaataaccggagtagtaactatacctctagcacctttacctatacccgcgggtccggctataaccgtacctactcctacgctactattattacctcctacgctactattaccgctagctataccgctattactaccggccgcgctactattactatcactatcactatcgctattactatcactatcgccgcctatacctccgagagctttaagagagcttaggggagagggaaacttattaaaaacgcctaattacttctaggcggctatctaactagcttaatagaagttatcgcctcggtatccttcctctaggaggtttataaaaacgagacttaccttactaatatcgaccttaccggacttagttaccttagtgttccctagggttacgtatagctctctcgcctaccgctcgatccgcgcggcctcggttagctctacgtcctagggtcccggctccgcgttatagtacttataaaaaataagtgatatacgcctaggcttagtatctataggcttaatagaaccccgcgcggtagtagtgaaacttctagtagtccctaaggactcgctaaggcgcttataaagacttcgacgaaatatcttcgatataaaagcgtttatatagataagaatcgataaaaattaataagaaagggggataaaagggggtaaaagtagggtagtaaagaaaggaagagagtagaagtgaagctatataggaaatactacactatctcaaagtgggagggcccttttatttataaagtcggaagtgagagtcctttaggtaacctatagacactaataggtggagtctataccttagaagcaccctcttttatctaaacgcctcttagatctccctttaataaccgctagtaagctaattttacaccctcgctacctattttaggctcctatcgaagaccccgagtcttataaaggcttaaaaacctttattactactattcttagagacttactaacgtatttcctttatttatacccctatatacctacactacctttaacgaattcgattttatacgtacggttattaacgatacctttccgggatctagggggagtttttgagctccctcacgtgaccttcgggaaacggaggaccgttttcctattcggttagggaggatataatcctagaagcctagttccttatataaacatatcttatgccttattagccggatctatatagacccgtttctgcacttatatacactatcgttaccgtattccatagtacttagccattggcaaagctaactcaataaaaaccatgcgatcctttccgaatctcatatatattagcacttagttaattcaaccacccgctataccaccaattcgctctcaatcctctaaaaattcaatagagaaggagggtaggatcttattagctatctaggcttttaaaaatcaaaaaatctcttctattcgtgaactagcgcgctattacaagataccacgtttaacactttaagaccgactaaacggccactaaagccgcgcgatttctcgcgccaattcgtataaactaacagaaattgaagaggaatctcttaaaaaatagattctctctatagatcgacgtggagtagccccccggccttctatagtacgagaaatagcgaaccttcttcttaaaaagcgcggaactaccccggttatttctattagcgaaaactaggtgacgaactatataaaacgacgtcctcttctatcctctcggttttcgaaacggtataactacgagcgtacgaaatacgaagacccgaaggttattagggagtggtttaatcttatttaaaaaactatccttcaatttaggatcgaccccgataatatttataactttaataagactagttttacgatagggttaatagtaaccgcgaaggttataataaggagtgaatactatagtcggcgagcacttttatagcctagaaatcgagaataggtgactattatcgagtgtacgaatgctactagctaggccctcccgctatatataatttttaaaggtaaagtctttattaaatcctagttcgatagcctcccggaggactagagatttaaggttagtcctaatagatagacctctaataaaattggacttcgctagcttaaaaagctctttattcctactacttcttcgcgtacgaagggggcgtatcggcttttaatactcgatagctatagaagttatttaaccccgagattcgataaaatctataaagagaataaaatcatattaatctatatacctccgtattcctcttatcttttatagcctctcgatatcggctattttacggtgttaaaacgctcgtatagccggatagttaaaataaaaatacggaacggaatcaattatatcgataaacttaatttcctcgaagtatatcctcttatacgaattaaagcttttaaattagagactatcaaaaatagctttcgatctataggtttaataccttttataccggagatagtgattttaaagcttaatattcggcttcgaacccctacccccccctctagctagggtagtgattaggatctaaaaacgccctcgaactatatctagttataaaagcaagctttgtcaattaaagtattgcttcgtataagattaagaagccccccgagcccgcttaattccgctataaactaggttttaaaagcctactagattataatacaatccgctatattactcgagaaagaagtgagcgatttacgcgctaaaaatgagaagaaaaagcaaaagcgaactcgatctataaggactatagtccacaaaggggatctcttagtttaggatattcgtaagctacgttcggagccatttaaggcctaagtagcgcgtattaataactatcgtgagtaggtttcggaaggtttaagaccgcccccctaggccggacgagcatgtggaatatataggaagctagggcatagaagagaaacatgcccagatagatgatgattttagtttatttaatttaatggcgttttggttgagataaatgcatttgaaattagtatgttgggtggggtggccggctcgcttgtgtggccggctcgcttgtgaaatacgttaactacctatgtccaacctgaaagacaaggcatcaagacaaacaacgggcctggggaaggacctgcatgggggacaatggggtcaagcagtcattccggaatcagagaatgtcgtgaatacccatgtaaacgcaaatccagagcttgtcttatcaccagcagattcatctgcacctggcgacacctgaaagccctcgagatcgttcggcagcctcgaagctcccaaatcccgagattcccgttgttggttggagacgttctcaatgagacgttgttggtgaaaaaggcaaccagccttggttcggttaggccatagtgtcctcatgacggcatttgttgcgaggagggccgagcgggttcctcttgggcagagaagtgcaggatatatccatccctggtatcctgaagggaaggacctcgacctcgtgagatgagatgagcgtggtgactcacctccaccggtggcccacgggtaagcagtctgggcagagcggagtaataggtttgttgacgacactgtcaaacgaagtctaggatcactttgggtctcatcatcatgtgagtaatctctgatgaatgtcgatttacctcgtcagcttaggtgagacatagtgccagaagatgtggaagaccactctagtggccatggcacatccgccaaagaatgggcaaccttggaaggaaggctgtacctggagaagatgagggatgaagaaagaatgggtcaggggatcaaaagtgaggaaagagctaacgacagcgaggaatgaaagaggtaggtacgaaacaaactacagaagttacgttccagttattcaatgtttatacctctacagcaaccaatatggctgcatgtgatattgaaagaagtatatgagctacctatgctgtgatagtatgacacagcattcatgcattttcttatcatcggcctgcggcgatagcaaaagtcaaggcgactcttcacccaacccaaacattctgatagaattgttccacgcactggagaggaaaaaggagttagcatggagccgagtatcggaacgagtcgacgaaatcttacgcttcgcaaacttcctccacggtgatacccttgacgctagcaataacatgagcaacacgagcgatggcaacaggctcattccggcccttcaccatgcaccccttctgccatttctccttcttcacggccttgggcagatccggtgcaccgtttaggtgctttgcagatgcatgagaagggcgaatttcgcactaggagaaaggttagtcatgatccggccaaagctcagagcaaagtacatacccatggcccatcagtttcgatttggagccgatcgagtggaatagctttgacaacctccaggttctcctcggtcttcatactacacccgttgacaccgacgtcaagacccagcgcgatcatccggttcatttcatccattgtccccgtgaagctgtgcacaagtccccgcttgggaagcttggcaagccttggggcaaggagtctctcaaagtcctcgcttgcagctctggagtggaggaataaggggagctgaatctcaacagccaggtccagttgggcctcgaaatacttgagctgaggttcctttgggctcaggaacagtcggtcataatcaaggccgatttcgccgaatgcgacagcatgaccggattgtgtggattcaattgccagagcgcggagttcctccagcatttttgagggaccgcctgggtattcgtcgaagagctttgcttggcatggatgtactccaacggttgcataacaaaagcccgctgcagaatccgctgttagtagacaaagggaaagtcctggcaagttcgaaactgacggtatttgctggcgacattaacagcgtgcttcgattctacgagatctgagccggtcaccataaactttgagcagcctacatcgcgagcacgctggacgacgtcatcgaggtcgtcttcgtgggcctgctttccatgatattcaccgcggaaaacgggatcactcaagttgataccgatctatgatttcgcagttagccaagagttgcatagcctctcgatggtgggctgttaagaaaaggcgacacacatcaacatatcggagaggcttaggttcggtcatatctggtgtggtctgttgtcttccagttgtggagactgtcttgggactcccagcagatatggaatttacaggggacagacccgccgagctgtaactcttatgaaaacctacgaaatgagtcagcttaagcttttcaaagaccacccagcctttgcatcactggactagttgataagtctatatctggacacgggacagacctaacgagacaggtctatatatgcctgttgaccgcacactcgaagtgatattgcggcggaaaagtctcaaagcacaactgacggtagagtttattcgcatcagatggttcgactagagatccttgttattgtgtcgttgaaatgccccagttcctctgtcgagacaaatgtgtgttgactcacggtcggaaaatgttcagccacactagggctgaggcttagttacactgtggctggtggtagttgatgcctgaaagtccaggcggctttattcagggaccagggacccactcggagggaaatccgtggtcccctcggtgcctcgccgacttgcgacacctcggaatcctcggaatctggatgttttcaaattggagtcattcggaactcagattaaaatccagttttctgtgctgcttattatgaattcgattggtctttggccttttgtacgacaaatgtgtgtggggttaagcgggactacatggtaaacaggttgactggcaatctagaaggccggataatcctgaagacaagcaagaccaagagttcaaaaatagaagctccaatacaacacacagcactccgtacagaagctggatgcttgaacaggaaggtcgggggactttagtcggtgcaatccggggtaagtccggggccattgccgagcgccatccccgcccttgctgagtatttagctggccgtggctggctgtttcgattctacctccacctcattaagcctccttcacaattccacatacaggccccgcgtgattaagtatcggtctcgatttcttcctagctaatccaagaacccgcacgcttacaccgtctgacagcaatggcagaccaaagactcctgtctgcccgacagatctcagagcataaaacacccaacgactgctgggttgtggttgacaagcaggtgtgggatgtgaccgactttttggaagagcatcctggaggatccgcaagtacgtccacgggtccgacaaatctatcatctcagggcgatatctaatctatctcgcgaatagttatccttaagcacgcaggaagagatgcaacggaggcctattcagaagtccacgcacctagcgtaatgaagaacaatctcgacccggagaagtttaagggcgtcctcgacgagtctacaattgacgccgaatgggctaaaccaccaccgggacagagtcccaaggtggtactggaaaacgaaaaaccgccgttggatacgttgattaactcacacgattttgaggtcgtggcttctaaaaccgccagcaagaagacctgggccttctactccagcgcagctacggatctaatcacacggaacgccaataaatcatgctttgaccgcatatggttccgcccacgagtcctaagaaacgtccgttcggtagatgctgggacgaatatcctcggcgggagttacaagctcccactgttcgtgagcccggcagcaatggcaaagctgatccacccggacggagagtgcgccattgccagagcctgcgcaaacaaaggaatcatgcaaggagtgagcttatatagtgtattttcattgtcagtcactatgcttacgttctggatagatatcaaacaactcatcatacacgatggaggagctacgtacgtcagcaccctcagccgacttcttcttccaattgtatgtcaaccgggaccgagcgaagtccgccgctctgctgcgccagtgttcagcgaatccgagcatcaaagctatttttgttactgtggacgccgcgtggcccggcaagcgcgaagccgatgagcgcgttaaggcagacgagagtctatcagtgcccatggcgccgtcaaaggcgcagaacgacaagaaaggcggcggtctcggccgcgtgatggctgggttcatcgatcccgggctgacatgggaggatttgaaatgggtgaaacagcacacgcacaaaccggtgtgtctgaaaggcgtgatgtcggcggacgatgcgctactagccatgaaagcgggacttgatggtatattgctcagcaatcacgggggtcgcaacctagataccagcccgccgtcgattatcacgctcctggagatccacagacgctgtccggaggtctttgatcatatggaggtttatgtggacagcggcattcggcgtggaactgacattcttaaggcggtttgtctgggcgcaacggccgtgggaatgggtcggagcatgctttttgctaccaattatggccaggagggagtagagcatttgattgacagtaagtgatggtttggtatcctgcttttatagtttgctgattcatgtttgtcgcagtcatgcaagatgagctggaaacagctatgcggaacattggcatcacatccctggcggaggcgtcccctgatcttgtgcacactggggatgtcgaccacctagttccagcgtcccgctcgcatccgtacgctcaggccatagctaaaggacggcgactggggtcatcgaaactttgaataaaaaaaaggttgggtatgagatatgtacatttgtactgggattgctatgtcggttgacaaatcccatagcgtggggatgcgagccatgtagggccatacagtatgctagaccagttgctcgacatagtagtaattagcgaccaatatacggcatatttacctgcctacctaccaagtctagaaatcaacaaaaagcaatatccccctccaatctaggggtaaaaggggaattattcaaccaattcccgccaagattcatcgccacttccccagggcgggcccttacagctatcgaatactcccgagcccctggtcaccaaaacaataagcatagccacttataaccttggaaccttccaaggcaggtctgctgaccttgacatgatttcgatccggaccttccgggtttaataagcgattgcggggtgagaaaagcataaatccgaatttgaaaacagacacgtagcatcatacgtagtatgttgtggatgatcatggacatctacacataatgacttataccgtgtagcacagagaatagggaaaatgtgtactccgtactccgtacgtactttgtagatcattcggaaggcggacccaactccggatctcaccgctccacttattaaaggactagtgtgacactaacttgctgaggtcttggaatattattcctaaaattaattcgaggtccatcaggtcatgggattcctcaacaatcgaggatcggcgatcaagcggtatcccccaaaattgaatgaaattccatatgttttgtggcttacgtgccatcaggctgtggtgcagaccgactcaccagtcgagagagagagaagggtgtgagagcgaattgtaggagccactcacgatcaggggattagaaggcgatatgcataacggaaccgttgtgcatatatcttcgaatcggataactctccccgtttttttcactttccctaggagaattcaatgaggggggcctacgttgtctagagtatgggcaggttataattaagtactccgtgactattcaacagattaccccattctgcaggaagatacccaataatggccgatgtctataatgctggtggttatttcattggatgatcatccaaaaaagacgtaatgatcaccggtttcaggagagtcgggagaagaggggtgagatggaatattcagaagtacggagacaaccttggaagtcgagaatacatcattttcggggggtaagtgatgtaccgggtacatcttgtcactccgtgttctggtgggtacggggtagcccacagtcccgatgactgggtacctggtacttacgccgtagatctgtgtctgggagaattgttgaactcagcacataactagcacatgggtagtagaaatgtatatatagagatcctcgtttcccctcttgccagctcatccgctggaaaattctgttttagctttcaaatccgtgaaatcacccactgctaccctctcagtgttgacgtgctctacttttttttggctcgacactatcgataacggtccagaccgccaagacgtggactcatagctctccccaaccattcccagctctataaagctgcctgtcctcttatatttgcatactcccctcatttctcacttcctcttttcccttatacttggagacctctgccccttaacttcgcaatatagctctatctcaaaaaagctatacatctatacacttcacaatcacaatgactgctccccgttcatcatctctccgcgctctccgtgctctctctcaacagcccgtggcaccctcttctcgccgctgccttcacatcaccggagttcagtccgctcaacccgccaacaacggcgagaagaccctctccaaccatgatgtcctccaatcccgcgccttcagcatcgccatgcgcagaatcaatggcagtgcattcccagagtatgtcccacattccatccaatacatctacccatgtctccattccaacctatcaaaaaaagtaacccccaaaactaacacgctccagctcctcttcctcacgccaattcaacacctcccgcgccacaaaagccctaaatgacacctcaaccgtcgacttcgtctacatgcccaacatggcagacctcgacgccgcccctctgcaacgcggcatccaagtcccggtccttcccgaactcccctccatccaaggccgccaaacacccaccgccccacccatgaagccccagatctacaccgtgtccggcaccggcgctgacgtccctgctagcgccatgagcgaggtcgtcgataaccacgccatcgacctggacccgttctcgcttaccgaggccgtcggccgctcacgtgtcggcgaggagatccagcgcaggtcaaatggttcttctgagcctggcgtcatacgtgagctttgggctgggttccttgatgatgttatgggtcccaaggagagtgtgcagaggaagtagagtcttttgattcctgtctctttggtccatccttgttaccttccagtcccgttgacgggtctgtgatgaaacgaattctcttgttgcttgatacattgttcaggctttattttgtcctttcctgtttggtcatcggactgttttgagatactagcgttttgatgtaatatctttcccttggagtggatgtcttcctccagtgtcagccagccgatcgttggttttttcctcttctatcttattccactacggctctgtcgagttgtgtcaatcaattgaacattactatccataccatctttaacaaaagccttggcttcttccattgacgtctcttagaaagatcgccctgtttgtggttcaattccgtctaatactctagtgggatacagtaagttcctgaggataacaatcgaaaccgcagtgactctttccgtgcattcagtctgccaaattacttccaaactattgtcacagatgactcaatatctctctgaaacaaacccgaaaattcccatttttcgttgtgccgaggcactcgatcgatacccaccatgatctacaaaagtagatccagactcccgggaactcctccgttaatcaaagtgcaccgttgacccgaggtcaccagactacctatatctccagcgtgagtcattcttttacttcccaagatccacgccgacaattgcaccacggtccaccgacgcatgtgcgccataccgagatgtgtccgaataaccctgaaagcgataattctaaaattgacgttcgctgtatgctccgacccgacagcgcttgtcttatccatctcgggacaatgacgtcgggatacccatttaagaagaaccggcgctagcataccgaatctagcacgagaatcgaatcagcccattctcttttcttccgtgtctccagcgccgctgcggtaatgtttttgcgggttccgaggtttgtttctcgttccttgctatctgcagttgccggttaaaatagatcggatagggctcgggtgtcgtggggaaggtcggagtcccgctcgggctatttcggggagagctggggtgattatctgatcgatttatcaatcgcttttcggggagtctggagtgtgtcatgtgataatttttctcctttgacgatggctattgtttgtcttttagtgttggggctatatgtggctggtcatttgttgcccaggcgttttggccgtaaggggtttgtggctccatggcttgatttgaatcgtgatctactgcccagatggttctgtgcctttggtggcatagatttatctacatcgagtgagccctccagttccctaggcatagagtttgattccttaggttgtcatcttttagggtagctatgtactattcactatatggccagtcgcgaacagttcccttcctcaatgggcccatttagccgaactaaatttatacaactattctctcgccccaacatgttaaatatcatgactctaagcaaattaaggtatcgtcatgtccaaaagtagatgtggatataccgaggtgctaatacctggtgcacagtgtgggactattgtactcccgtagcggattttgtgtcaagtagtgtatacgttcaatgcggtggctgtgatgagacaggtgcaagacattgttagacttgcagggtttgtatgacatgtgcactcgactgagatatgcagtacgtacggagtagtacggagtacacggaggatcaagtacacggaggatcacttcctggtaactggcttggttcataagagaggcagggactatccagcttctaggtgacagagccaacactcgccccatacactatccgcgcaggttgtgatgcagcaatggaaactcctggatatgttcggttttagagtcagtctccacagttaggtcatgatctacatgatatatccgttttaggcctcccactgttatactttgcaattaattggaccaggtcaaactgcgcaaagtgcgtactctagctattcaattttgaatcaatctaaattgtttatggaatgacttggagtaagtagacacaggtatctgcagagaaaaagtggtccctgtcaaggctgtcaggatcaaacggtctcgacccaagtggaggcggaaatctgagtctagacctcatgtatacacctaatagcgtctgtacaaagtacggttacattctatagcatacgtatgggctggaattctatttgttccctcttttcgtgttctggttttgtcttcaggtgtcctatgaaaaagttcaatactaagctttttagcgatttaaccacctaggtacatccatggatgtacttcactccttagtttctaatgttactatagactgtgagtgtcttcgcaccccgggttctctaaagcaaccacagtcaatagtattaaaatagagaagattcaagattcaatatcaatattgtatgatatcccgtccaagttccttgatatagaacatttggctccactagcttcatttaataggccgatcgatacccgaaatggcgttagacaagtggaggaaggtggaagctaatcctattctggtttagagccaactggtgttcttgccaacttcttgttcagggggggttttcaacggtggagaccctgtcccccctcacatctttcatggcacatttcgagtctctccaacctcctggccttttgttcattacttaatatcctgtcttttctttgtttttttcttcttcaatttcactctctatcacttaattcaactctacaacttcgcgagtcccccaattcctcagcttcatacagcgaacagcggttatattgaatagagagacatacaattgaatccagcttcaattcgtcaaatgcaggcttttacattttctatctaaactcctcagggatcatgcgtctgtcatcatgtctggtcttcattgccggcatctcaggcgtgcacgccttctatccatgggaattgcggatgaaactctccacggaaaccacagttaaacgtcgcttcgtcccgtggaccttgattggagccaaatccgacgacagcaccgatagcaccgacacatcaaacgcagccaacagaaaacctttcacccttgacctaaaaaaagtgccggttcgccgcgaccatgtctataagatcgtcgagtcccacaaaccgtcattggcagacagtgcaccgttacaccaggacgggacggattattcctacttttcgccggtctatgtaggttcccaaaaacaagaaatgtggatggcaatcgatactggagcccccaatacctgggtcttcgactcgaaatgcacggagcctgtctgcatacatcatcacactttcgaccggtctgcatcaaccagctttaccaccgacaatttggctttcagcctcttttacgggagtggcaagatcgacggcaagatggggaaagacaccctctccattgcagggctcgaagtcttgcaaacctttggtctagccaacaatgcctcggaaacctttgagagttacccattcgacgggattcttggcctgggtcggtcgcatacatcagggtggaatctgccatccttcatggatctcgttgcggagaaaaagcttatcaaatcaaacttggttgggttcagtctctctcgctcagaagacaatcacaaggatggggaaatcaactttggtgatgtcgatacaaccaaattcgatggcaccatatcctacactgctaccaatgacaaaaactggaacatccccctggatgatgcttatgtgaatggccaaagctgcaacttttctggaagaaccgctaccatcgacaccggcactacctatctcctgatccctcccgcggatgccaaagccctgttttctctagtccctgactcctctcaacagcctgacaacccgaacaactatttgatcccatgtaactcgactgccaccatagaattcgagttctctggtgtcaagtataacatctcccctaaggattatgtcggaaatccggagccggaaggctcggactactgcatttcgaccattgtcggctacgcatcaaatggtgcagactggctcgttggcgatgtctttttgaaaaatgtctataccgtcttcgatttcgacaatggccaggtcggtttcggcgcgctcgcctcggcctcggcctcggcctcagccttgaagtcgaacttagacccatcttcaacctcatcctcttcatcctcgtccccgccccaaggcaatgggacattcactgcaccgctagtcactggaactgctgcgtctactgctgacgccacgtcatcatcatcaccggcctcctccgcaatggccacagtatccggcagctccgcatcccacctcgtccacggcattagctggtctatgctcacagtcatgattgccgcattcgctgtttgaactgcattttagctcatctttcacttcttgcatctttttttgacttggcggcaatcatattttgccctttgtctcaatgtacactcacttatcacccctgtcttttccgtgcatatcgattatcctacacacatctcacttcactgctgttgataccttcgttaatacacccaggtccacatactaccacccacccattctaccatgcattggcggcactgtctattcggccttttttcagctgcatatatccatcgtttctgttgaataccaacgtgtacccttcgtttgaactggacatgacttgttattaattccatttagatagacaaaagtctaccttatcattggcaagatgctacaatctcataataaacagttaccaatttgtaaacgtgtttgatcagtgccacttttacaaggcttctatatgaacttcctatagttaactatggattgggcaagtgaggtgcgacattgagagggaaggtgcaagtcagctgccaacttgaggaaggtacgtgttgctgggggtataaaagggctcctctcacctttcttccttttctcttcttttctcttcttccttctttctctcagcctcccgcctaccgtctctccgtagcccatgagatcgtgtaggcgaggcaaagggccgtgcatcacctatacataaagacgtcaacattaccaaggttgttgaggtccatataggtccacacccaaatcaaaccaggctttctcgtggatgttctttgacaaagtcgtggctccatagccacttgacgggtcccacggaatacatggggggtgttaatcacattctcttcattatacagctagtcacctaggtagtcactgaatagatttacagccgaagacgtgtagagtaacaagcagtccctgtttacgagctaggcaatgctgtaggtgaaatcaaaagcagcatccaccccggaatgtcttccattcacaaagtcttctgtggcatgagcgtataattcttcggatccgactctgtatctcaaaatcagcatccatccttccaccacacacagtagacaagactgaccaagaatgtcccgattgaaatcctcaaccccgttgaacccagcaacacccatcagaatatccaaatccgccagcaacgacttcataacatgcctaaccccatcctcgccctggatactcaacccccaaatccaaagccgtccaataaacacaaaccgcgccccaagcgccaacgccttaacaacatcactagccccccgaaccccagaatcaaacataacataaatcttgtccccaaccgcctccgcaatcctctccagcgcatcaagactagcaacagccccatcaacctgcctcccagcatggttactcacaacaatcccctcaaccccaagcttaacacacctcctcgcatcactaacagactgaatccccttaataacaaacggccgtcccccactaatccccctccaagtctccatcaaccaaggaatcttctcccacgaccaagcccgcccatgccaaacagaatcaatccacttcgtcgacgccgcaacaacatcaatatcaggatcgataccatccgtaacacatctcctccgaaaaacaggatccgaaagccccacatccgccccgaatccgcggtagaacgcatagttcgacgacgcaacgtcgtcatgtcgccatccgagctgccacgtatccgtcgtgagaatcagtgcgtcgaagccgttttcccacgcccgtgttaggagtgagaccgttacctcgtcgtcgtgcggcatgtacagttggaagaaccttgtgcctgttccgtttgccgaggcgactttttcgattgacgtgctgccggctgttgagaggcagtaggggagattcagctcgctggcgacttttgagaccgcggcttcgccggctgggctgtagattttgtttattccgattggggcgaagccgattggggcggataccgagtggttgaagattgttgtttttgttgagcggttgtttgtgtcgattagttggttggggattagtcggtggcggtagaaggcttgtcggtttgcgaggtgtgtgtttgacattcctgcatttgaggaggcgtagtacctgttgcgggttttggaggttagtttatgtgtcttgggatatctggactgctatgatggggaggtaatatgtaccagccgccctcgctcagcttctctttagctctttcttccagttttcgggggtctatggaagttagaatttctgcaggttttaggaatcatagtgaacactttcctgtattgaacagcggtgtcgttccttcattctgtttccagaagttctctcgctggtaaagagcccattggggtgtggtacgctctttgatatgtgggtttgttgggtcactcatgttgcaaatagatgaatccttcttgatcccaggttcttcaattcgaatagaaatagaggtaaagagctagttgtgctcaatgtttgaagtgagggttatagatcaatatctcatcgatgacctcattttgacgtttggccatcagaccccgggagttggttaagcttaaatgaatttcaagatagaaaccatgggttacgatgttctcttcacatttaactagctccttgcagttgaacgtattcgatttcaaccttggaacaccttatgaagtatgaccagtaaggacgatttctcatacccttacagatatatgtatatcaaaatccggcgtcagcattagcccgcttaacagaactacccgattgtgattatatctagggccctcatacacttacactttgctttagaggccaccttcagctacaaaccgcatctacagaacaatatcaaaccttcgatcgggagcgatgacatcgcttttcgtatccgggccgagaatcgccgggggctaaccggaccgggtacgaatacggtaagcagcagtgaccatgagagacttaacccgtagactcatgagttctcactccaacccaagagaatatgtaagctttggtgtattttagctaggccaattgtcttcaaagccagctgccatttggataaactaattgaatcgagtacattgccagttaccagggcggtcactttctgcccagccaccgggtaattaaatctcttttggtcactaattcgcgctgtatacatcggatcctcggcatcgtcaatttgttgagcaggggtaaagtctactacacttctatctcagcttggtttcccttcctttgacaacacaatgtttggcctcagcagaagatcagcgcttgctcgctcaaaatctttggctgcgctgcccgccagagcggcagtcgcagctcagccatcctgtatcaacacccagggcttccactcgacgccatctcaggcagcgtcccggccgacgtggatgcccatgcgtgtcaagacaccatggattgaagcattgacccaaattcgcgaggcccagaaggctggaccacaggagaatgctggccagagcgttaagcgtgatctctcgccaaagaagatgtcagatagctattacagtgctgtacgcatgatcttttgtattggtgggaaatcagtttgttgatattgactgattggtagattttgcctttggctcaagacaaatggcttctggattcttatctcaacgcctccgggcatatcaggtacgtttttgatagcctacttatcaaatgagcacttgactgatcatttctagattgggctctcttctgatggacctcgatgccctagctggcattgttgcttaccgtcacacaggtgacggtgtatccactgtcaccgcggcgtgtgaccgaatcaccattgagaaccccctgatggaaatctgcgaccttgagctcagcggccaatgtacctacgcgacaggtcgatcaagtatggaaatctctcttcaggtcaccaaggcccgtccggaaggacaggaggcgaagcctgaagacatcctgatcacttgtgctttcacaatggtctccctggacccggcgaccaaggcgtatgttccttcattatcaaacgatacacacaaactaacatcaaacaaggcccgtcccagtggctcctcttatcgttgaaaccgaggaggaaaagcgcctcttccaaaaaggcgaagcgaattaccaagccaagaaggccctccgcacacgcagtctcctacagaaatcaccagacgacgaagagagcaacctaatccactcaatgtggacaaaggagatgtcctacctgagtaagcactagcccttctaccgatgaattgtccaaatacaacaatactaaccttcccagaccctcaaaacccagcaacccgccccgcaaaccaggtcttcatgagcgacacagtcctcaaatcggccatgatcatgcaaccgcaagaccgcaaccgccacaacttcatgatcttcggtggcttcctactaaaacagaccttcgagctagccttctgctgcgccgcgtccttcgcacacgcacgaccaaacttcgttgctctcgatcctagcacattcgaaaacccagtccccgtaggcagcgtgctgtacctgcgcgcgacggtttcgtacacggagcccgaggagcgagagggcgatagcactaagtacaccaaggttcaggtgcgtgttgactccaaggtgcgggatgttgagcacggcaccaagaagtccactggtatgtttaactatactttccttgttgagaaggatgtgcaggttatgccgaaggggtatggggagtttatgctttgggctgatgcccgtcgtcgggcgcagaatgctgctgctattgatcccgcgcataagatgagtgcgttgcggagtatcaaggatagtgttactgagtagatggggttggatggtttcttttgttttctgggttgggcaagatattttcccattagatttagatcggttagtgtttcgtgtgtttgaatatttctgcttttgtcttccaatggaacattagctacatactcattgagtttatatgatcagagtagcattcaatactaagacatctaccagtagttggaaatatcaaaatgaccaaaggcataaaagccatactttgtgaaggctaccatgcaaagagaaaagaatctatatacaacgccccttcgcctcacagttccatccaacaaaagtatgtataaaacgggcggggaatatatataagagcacagaagaacaaaaaccagggacataaaccgaacgcaaatattccagtatccagtatccagtattccagcattccagtattccagtccaccttgaagaaccaatgaaaccgactccatgtaaaaatgagatgagaatgatataagggatccttccaggccattgcaatgcaaccggggtaatacacagaggctgatcaaactgaaaaacataccagtcccgactataactccctttgccccccttctccttccgtggaaaaggaaaaatttcaaaaatgttcgtttcagatcgtgattccaggcttttttgggcctttggtggctttgtcaagtgtcctgtctcactttgccttttctagtatgaatatgagatttttttgttttgtttttgggatgagaaaatgttccgggtgtggtgatagtgagattgttgagtgatgtcgagtgatgctgtcttgttataacagatatgtggcggagacccaagtttcgaagatatttgatactcatcggtaaatccgaatgagtttagtctcgatccctcagaagagaagacacgatcgttaccacaaaggtgaaccatcatccaaccccggagtatgaactagcgaggaatgcaattaacagcgcagatccgcttgcggggaaccgtcttgcagccggatgccacaaggaagagctgatccccgatcaagggagacacaacctgttgattgtcattgctcgcggagaacttccgagacggcgttggacgtcaacggccctgcagtctgggtgccagaagcagctttatcctttggcccccgaggctcacgacgctccggcggctgctcttctttcatgcaagcattttccaagatattagtccactttccactagtgccagcgtggctatgcttcagatgctgtcggaagtggtctgcgcggaagaatttcttggcgttgttgcactcgccaaatttgtgcacggtggtcaagtgctcgaatcgtcgatcccagtccgcctgagggaaattggggaattcctccccgcagtacccgcacgtgtcgtgggtagctccggcatttgtttggcaggactgtgcgcctgaggggtggaatgctgcttggaaactgacgagcgcggcgcatgaccatgaatggcgtcggaggtggagggagttttgatggcgctcggcttcgtttttgttcttgaaccggtggttgcagtaggcgcatgcgtactgtttctccatctcgtgtgctctatgctaagttagtctgggtctgataatgaagacatctaggcgtcaacttaccgcaggccatctgggttgtcgaatttcttgggtttctttggacagcaatcgcagatgaaaagcccgccgatcttcggcgccgcgggctttggcacgttcataatggtcgtcggtacaggcacctttccagtggcgtctgtcgcaggtggttctaaagatgcgggtcctgggagtcttgaaagagtaggctgagatagcgctgcaggagggctggggttgaggattgatttttcatggaaagtatcgagatcggagctcggcgaaaaaccacctggtgatggccggtcgtacggagaaaggctcgtcatactgctgcctccaatagacagcgtagacgaatacgatcccgaggtccggatgctcaaggatgaggcggccgagagggttcgctgactcgtggggtagtggtagttggggttgacggatagtgtgttagtaaatggatgaccgctgagtcttcgctgagacaagtctccgttactcgtagtgacgtgcaatgtatgtctctcgtcgcttatcggctcacgcggaggtgaggatgcccgtcgtttcatgccctgcctagaatcgggatacggcggagtgggctctcgaagaatgaattgccgcgggggtgccagctcgtcagtcgaaaactccccctcgatatctgaaaacgcgccctggtcatagcttccacggttcgatcggctcggtaaactgatgctatcttctcgctgtggcgttgtcccatgatagcggcgtcggttcacatcccgtaaagatccttgatcgtaatccagtgctgatgctggtgcattgctctccacgcttgggcttcggccttcaacatactctttccagttgaccttggtcctgggagaaacacccccggactgagggctgttgtgccatttcacatccagcgttgacccctcagaaggccctggggatggcagattgcttgggcttcgtgagggaacggtgagcgccgagagcgaacttcggctgtcggttccgagactgatagatccccctggcgacggaggttttgccatttgaggcttcccaattttcgataataggtgttggtcgtaggcatttgatgagtctttcacgctgcgcagtgaaaattcgcgctcaccactcaagctgtcaatgtgttagcaagaatcaaccagatatagaaaagcgcggtactgcaaaaccgggagttgttcgcagtcctcgcacatcaagtgcgcttacattggacccgccggattgggcataaccgacatggcattcggaaatccgtctgtagctgatagaggcggctgaatctggatctgagtttcggggcttcgtgagacgggggctccctgcctcccctctaaaccgtctatctgcatcggatcaccctgtgaggcagttaccggccgtcgatggcctccaaacaggcttgagctcgggttgataggcggaagagaagtcggagtttgtgagtttgcgtattgccagccagcgtcatggcccatctccaaatcggggattatgggtggcggtggaagtggtggaggggcagtgtccatagtagtcctagttcgtgaagctataggtaacgggccgtgagatgagaatgccagctcgggcatagcgtattggtgtctgtcggaagaacggtgcctgtgttctctgaaatcatggaagctcgactgagaaaaccgaaggtccattctagaaccagaacatagagccggaatcgaaatcacgaactggtgcgcatccacatgaacttcaagatgagatcaggcagatacctagtaaagcggaagaaaaggtcgagcttgatataaatcggaacaagcaggtcgaatcaagatctcaatatcccagcaataacccaatccagttgaatgcaaacgtcggtcgtgaaaccagctccgattgttaagcggaccgttaaccagcctcacgatgaagagtcagaaggtccagcttctggttcaagagagaatagtttaatagagtgactttatgcagtgataaagtctgagtctaattttgagagtcagaatcatttgaaagtggacttgagataaataaaaggccggggtaaggagaaatagggctgaagacgacctacctcgggacccttgttcggcgattcgcctcataagatgaaacgttttcccgtaagtgacacacggagagccgggtctgtgtcccatagaaattggccactgcaattcaaggagatgcacacatgctgaaaataatatggagaaaacgaaaagaaaacaaaggaatataactagtagtgttagaaaggtgcgattaagccgagagatttcagtataaaagaaatacacacactctctctatgcaatgggggtaccccactagctgaagcctggtaaaaaaagggtgttaaaggtaaaaaaagaaggctgaaggctgagttggagagctggagagctggagagctgaagatcaaataaaaggcagaagaagttgaaatgcgcccagatcgtatcgggtaggaattcgggcggtgcaaattggatccaattcaggcaaagagaggcaatttaggtgatctcattcctcgaagggaggaaagtgaaagttcaactaatcagaggcaaagaggcaaaaaaaaaggaaattgaaacataccaggcttaaggcctttggctgacgtggaaggccgtatatgtatgtatcgtcggtatatgggtcatgtccgttacataccaattacagggcaaacatcatttcttttttttccacttttttctttttctttttctttttttttaaaaaagataatctgacattctctaattaaacattaaataatcccgtaatttaaatttatataaaaaaagaaaaatttgattggattttccagatctccgcgtggaaaagccacgtttgaatggcaacaggttccttttagggcacaaggcttagcgctaaaaaagactcggtaattttgtctccagatatattggttcgatacactattgtattagacatctgggtcccaagtactccgtaccttacgctatagcttctagcgaagacatctgggtctactccatagaacggggaaatgaatggactggcccagagtccaagttccagagttcatgctgatctatgtgacgcgccctaccccatatggagtcttcatattacttgacgggatcatggaagccaaccataacattgcagaatggccgtgcggccaaccctcacaggtgggggtctctcgtatattggacgcctcgcaaatgcgacccagatgatggggttgtccacatattgttaatccggatataacgctctgttcaatcttctcttggctatctttactccgtacactcattcaagaagcaagttgcatgccaaaaaaaaaaagggaaaaaagggaaaacacgaattttagtggcactgcagtgtacttacatactccaagttttttttaaaaaaagctatctcccatcttcggtgagacgaaaacggctttgacaatgcccaggaagaaacacgttcgaggaaccatggtttatggtcttctagaactggaacttgttgagaaagtgctagagaggggtacaggggtacggagtacaccctcctcccgagtcattgggagaatgaagtatagattggcattggtcttgtgtggtcttgtacagtttcgcaaccagtgataatacacacgggggggcttggaaatcttggcatttaggcttaatatctcctgggcaaggggcggcgacaacactcctgttgatggtttttcttcttttaaaacctgaacagtgggcaggttataagtactccgcacattgtacaacacatgtgcaatctcatggtacaataaacatacgacaagatcttgtgctgcatttcggaggattcggccctacattcattagagaacattcttttgcctccacaaaaaaaagcggacaatgctgagtcgttggacattgaccccactgatttgctagcgcgctccacttagcgcctagcattgcatgcactgccacactgccggtccgcctgtcattcgagcgcagggtgcgaattttgaatgtggtgtgatcaagcatagagtaagatatgttgagctggatttttgaaaaaaattcccagaaaatgacgtggtctttggagatgaacgtgaagaagagaaaagagaacgttggaacaaaccctccagggctgcagggaacagggctgagtaatcgggtgaatgctccacatcagcttcgagaatgaaaatctcaatttttctttttccttttggtttcctttttaggaaatattgctaaattaggtattttatccgcaaacacattagactagtgttactatacggagtacagagcacttacccagtagtctacgttagtacaatttatgtatgtaatataatggggtttcatcccaaggagatggtcgaactctacgttagatgtatacccctggagccctatcacacgtatgacgatcagatcttctgatcagagcatctaagtctacatggagtaatgattatctgctctcaagggagggttgctctacaagtacggagtacgttgctcaacatcaggattttgtaattgcagagtggcagtgtctttcttggcagggggtattgcctctatacatcgattcaccctccgtctgctccgtacacggagtacagagcggataccaagatcacatgtatattgtacagtctaatagagttttccccgggcccattatgtatgtatttctcatcgatcgtcgccgtcaagccagttgatgttccaggaagcgcccttaacttatttaggaaataattagattgcggtgggtgatggttgactacattggtagactgtgctgtacacaactccattgaggcgtctgtttccgtatttgcttcgggtaatgattaccagagcctacaggcagcaaagacaccttttcaacaagaggcgtcagcagagaggggttaacggattttgtacggagtggttcggctggcttcggctggcaaaacccagtctttgccctgaaactgctcctgaggcgcagccagccttaagccttagtgggctgcagcctagaagcgcgtggtcatgtaacgcggacaggctaaccaactttatagtatgtaagttatatccatactccatagtgaggccgtatgtggtatattgcctccggtcccgttcattgctccatccctgtcagcctagatccaagttccccgcggtaagcctaactaagcctaaatctagcttcctttttttgttgccccgtgagcacccccttgcaggtcccatagcaaatcagatcaaccctattatagattggctgtttgaccttcgttggatgtaaatcgcgctccatgttgcgagaaaccctcggcgagacttgggatttacaagtccagtatatcgactccgtatgcactgtgttacgactacaacatagacactctaaacttctgtacgatgataactgcgcgttacgtctacaactacatgtatattgaatgtaaaacataaagggcacgtggtcggcaaaatgaccttgatgtttggttgtgaattcggtgtctcacttttgggaaggcctagttaaatccctccttagaaatgtgtgcacttaatctaataaagtccttagaaggaaaatgataatactactcgtgacatatatgcaccaacccggagttggggagattcttatgcaatggcctacgtgccacgccatgcaaaactctacactctcttacagctctaattatgtatatttaagttaataaatggatttcaggtcaagagacaattatacaacagtattttccttgacacaaataaacactggtctgaaatatgttgtagttataaaaggaagtatggcctgaggcacccaagtcacctgctttgtcatacccttgccctatcagactttttgagtttggccgaggctcaacctccgcctttgcgatctaagagaagaaaagagtcgagttatcaaactggcactggagctgagcttcgaattctgtatttcctctgtcaccatcaacgaaacgtcttactgttgttgagtcgcatccaccatatctcaaaatggccatgaatcaaataaaaggccacaatatctatgtcggagggttggtctcactctactaacaaacaatccttgcccgggtatcgctaaaatggagctgagactcgagattggccatcaaatcctgatttagcggtttccattcattgctaacgcgccatttgtagcataataggcgccaaaaataaagcagcattggcacgtgcagatatcacgcatgttctctcagtgctgcgtcttaatctcaacctagccgaggagcaagagactttcaagccttaccatcatctttccataggagttgacgatgtcgacgatgaaaatttattggaacatttccctgccgctatcaagtttatccagtccggcctaaacggtggtggaggtgtactggtgcattggtaagtcagaatacatattttccagtctcacttgtggaaggtttctcccagattctcaagatacttttcgtcttgaatgcatattctcgagtggcttcgtgcctcctacgtcatcgcgtatccatcaagtgcgatctacacgtggcttgagaattttgcacatccttatacacgttggacccttttcctgaagatccaacaagctgcgtctggccttgcccatcatggaacgatgtacagtggctaatttgatgacccagtgcgatgggaaagtcccgctccgcggccatttgcatcgcctacctgctccaccggcagccgggggcactcacaccgcaatctgcccttgcgctgcttcagcaaagcaggcccctatgtgagccaaacgatggcttcatggaacagctgaatttgtaccatgagatgggctgtccagatgatgtcactgatcatcccgtgtacaagcgctggctttatcgccgcgatgtcgaaggcagtgtggcgtgcggccgtgccccagagctgaagtcggtgcggtttgaagatgaacaacccgttcagtcccaaggcgccaccggtcgaacagtcgaaattaaatgtcggaaatgcaggttagtcccacaattaaagatccagacccatactcctgagagtcaaataaaaaagaaacttccagatttactaatcccatcgcagaaccaaattggcgacgactccattcatcatcccgcatgaggaagaaaagcaaaacaccgccaagtcctcagtaaccgccgattgcggtcatgttttcctccaccccctgacctggatgcgcccaagtctcttcccatctgagggagctgaggctagcgcggatacaacatatggtgcgcaccctgacgatgcccccctctctgggcgcctcacttgccccaatcctatctgcgggtccaacgttggcaaatttgcatggcagggtctacgctgcagctgcggtggttgggtcgtgccagccatcggtcttaccaaagcccgtgtcgatatcgcaaaccaggtcaacatggctcaggggccaagagttaaccctgccatccgtcttcccccgggaatgcgggccctcgcagctaatgactctgggcgtggcaatctttgagatgagaagtgatgatcaacatacatgcatacatagttttacgagttatgaaagcttaaagctcctacatttgtttatcatattttggttgtttttgttcggttctagatgatcgtgtgtcaaccaagggggctcactgggcttgtcctaagtgacatgtggtacatctaagcttggacctgggagccactccacactccgtgcacagctgggtctattgagacacccactctttggtgatgaccacgtgccgcacgcggagagtgaagattgtcgctggccataagaacatgactgccttgcgtctcgtttcattctacatactccgtacaggcagcgacaatggcatagtgaggctcaagaacaccgcctccgacctttccagacaagccgctaaagctgacaagagattcccccatgctccatcccatgatctacaaaagcaagacacacattaggcaggacaccatgcccctgctgatccgtacagccgctgatatcaatccatctccaaacgcacaagccattagtcctcccgaaagctacctatccacctatcttgtgattcgtatccaaggcccccgttcgacaaggatgccatgtcccaccaaaaccatcttgcacaaactcaaagatagagtaatacagcgtcggcgatatgagacagagccaaagccccatttcgaaccgtacatagtaattaaactccagacgggcttaccttaccctagggctgcaccgcataccaaacgtgcatcagtcgactcgtggcctttgccttagcccttgtcttttttttttgggtttattttcccagggtctgatcctcgagccatatgcagctaacgcactccgtaacaggcacaaccttggaaagcaatagttaatcgcgcgccaaggacctgagtttctctagccaaaagagtagatcccaaatcagtggactaagtagactccactctttctttttcccagggaagtggccccactcaccgaagcgctgtcagttcgagttggatgtttcaaagatcagcgtaacgccaatgacgggattgacccaaatttccccccttctgccgacttccaaggtttgaagcagaaggaggctgtgcaaagcgggtctgtttcctggctttcccgattggcgggtagctgtattggtattaccagtatctgcttggtatgtgtttgtttactggggtatctggtatttttccataatccagcccttatatcgtccacgggtgttctgattggaagtttctgtactatacagtggacgtttcttgatgataatatatgtggttcttactagttgtagatctaattagtgtacaaaccttcattggttccgttgtttcgcaagctggatactttatgaatgtcactttcacattttgattggcaaccctttccttgtgggggtgggcagtgcactttgccttgcagggggagctcccggtggagttcccatctagtctggcttggtgacttaatgtacggagtacacgtcctttccacaaccatctttacatagtttatcaatgcggtcgtgatcgccttgcgtcgatcgctggcatttttaactttgtttcaggtttgtctgggattagggcttggtctcttggtatggatgagatgttgtatagcagttgcttatgatcaagtctaattaggagaggcctaagtactatcgttcgtgtctgggataaccccgtaatcgtacgttctcaaggattttgccattaaaaatagtactagtctcacttcgttcactatgtggtatctgtgcagctgtcgactattctgcgttgaacaagccttgtgtctcatggcgacattgttgtcaactagcgagctacgaaataggctgccaaatacttttagctaaataaagatagcactgtgcgagttacactgccttcgaagtttgagcagcacgtgcatatcttgtactatgctcacatgaggacaacatacggagtatctgcccatataccacagagtatcccggtataataatgactacctacacttatcattttagcttagcactatatatagcctttcccgaacgcatccaatcccattgtgctagtttagtaggccgcgtgctctctaccatctaaacctgccaggcagccttcagtcgatgaacatggcttgactagttcgagaaaggcacttatgattctctaacaattatagaccgcgtcacttccaggcagctgcgtcggtaattggagtcaaatcttcacgtgtctgtcccagctctaaaagcgaagtgggcatgtagttgtctatattgtgggctatatatagcgacttgcattgaaatagccccggacacgggatgagaatacaaagatcggtatatgtacgtaccatggtagtctttgtaccaacgggagttcgttcaagtatcacatgcatcgaatctcctatggccgcagcaaatacgccgtacacgagtagatgtttcaccgaagcccgggagggcacagaaaccgagtaagccgcccactagggctgaggcagttttgatgatgggctcgtggacggctctagttaattagtgcttattataccccacccaacatcacgaagtcacgcaatacgtgaagagcatcgtcggactaaggtatatattacaaagaataaagagcaaacaatttccggtctggagatatacagttgcccgggcgagagtggccgaggattcattcgaaaggcggactctcgttggacgcctcgttagacaaagtgtactaagaacaactgggttgcatggaagtcaccggcttgtagattttgctactgcagtcgaatcctgcaggatcagaaattcgcttattcgagaggtaaacatattccacatatacataggtcctaggaatgaatgtgccagagtcaggagcgcccggtacggggcgccaatgccacgtcgacggcttaaaccttttttgtcggctcaagattgtatgactcggtgatgattgggcgggacgcccgctaagaaagagaagacatatgtggggttatgaagcttgtgtgactcaatcttgcgtcggctgttctccgtaaacctccaaccgggtcaaaacatagggtaaaatggatgattcgataatcagcgattgacggagcaccagatatgccgtgcgaagtgatggacatcagttgtcgaacatgccttccctggtttgcatcgccttctcatcgcccgaagctttgtgccaggcagattggcagatgacgctggccgaaccaacctggcgttcttatctcgaactacctacctatactgacgcccaaagtatacaattgagcaaaagtctaaggatttcccgacggcacggagggaaacagcgaaggctgccttaatctttcctgattgcgtttcgccatttcaatattgcgcagccggtcgatgcgcatctgatagaaattcctgttgcgccgttaggagtcacttcatgaaaattatgcttatcacatacttgtgcaaagagaaaattcgaggcgaatcatctgactttgtctctttcccggaacctttctggatagaagcgatctggcagggagaatcagtcaacgcgttcatacaaaggattttgcttattgaccttcgctgtggaaagttacgaaccttatcatctctgtctttttcgtcgttggcatttgactcggatgtatctttgtctttgtctttgggctcatctttgcccttgtctttttcgtctttattgtccttgctagacgccttctcacgttctttcttccgtcgttgtttttcttcgtattctttttttaccttttcgatctccttggccatttcctcttctttgagacgttttgcctggccctccgtgtcgatgattggagagcagaaatgcttgtcttgcaaatgtgcggggcacacgtagaagaagtcctgaggagtgaattagccacttgatatacataaaaataggaaatcaagcaaagaaacagtctcttatactatgctctagatctcaaatcagattgcataccttgttatccggtgtgatcatcacactggttgatggtttgtaacaaatcaaacatgcttttgcagaggtatcggccacccgacgcacgtggtagacgtttgtcaatgacatagttataaaccgaaatgtcctaagctacgggaagtgcttcagagcttctgttgctgtttggaggccgtgttgaacaagtgtagatggactggatgaggttggtgttgattgagaaagtgccgtcatgtgacccatacttccaagagcaagtcggatctattgaagtctttacaagataattggaatccaagatgccgcgctgacggaaataaggcattgattcactgaagctgatattgtatttcagccaacaccagcacgcccatcttaacagaacgccggaccatgcatttgttcaccgaacaacccggtaggactagagaacaggacgagagatagcaatacatgaagttttatgaagagaaatcatgagatatagcgagcattaaaagaatcgcggcaaaaaaagagacatagatcataacaccccctccccatcaatgccggctgcctccgttgctagtctcaaatccttgcctgcgataccgatatcgcgcaagtaaggcctgaaggctgtcagtagatccttaagaccaccacggagtgcagcgagcacaatttcaacatctggaaccaggcgggcgactgcttgcgcctggggatcggtcgatggagggaagttgatatcggtccagtgggcgtccaacgcactctggtgggcaaatgcattcagagcgagggtggtttgggtcaggagtcgcacggctgagggcacatcggcctgaactttgccatacggatcttcggccaagctagcaatgaggagtcgagtcagcgactccacagcatccacaatcaaggacagagaggactccggtgtgccaagaacaatagcagagagacgttgagcgtatgtttgacggaaaggttgtccgataggcgaacgaagaatctgcgccagaactgggttcatgtcctcgggtttatgagttgtggagggactgccggtaagtagtttgaacttctgaggagagccgagggatttctgtttctgctcggggctaagcactgctgaggatgcccgatcgaaaacatcacggacccgggcccgggcagtaggagtccagtcttctgattgaccgaaggatttagccgccgagctaaacgcatcgccaaatttgtcctggcgcgaagtacccttcggggcagtggtaaagatattgccgtctttgattggttctgagagtcgcgggagagtttgaagaacaggctcggatttctcggcctgcggcaaaggcttggtaacaggcgcgggattcttgctttcctcgatgcgagtgttaatggccttgattacatctgtagtgcaagcaagaacctgggaccaagccgaaccaccttcgcgatcaatttcattgaaaattgccttccggcggtcgggaacgcgctggcttatgagactcagttcccagagcgcaaaagtcttcacaatttccttctttgccttgaggccactaagaagactgccattgggatctttggcttccgttgtgagtggctggccccgcttcaaaggctccttgccgatgaacacagaatagaagatattggcagtttgccaggagagcacaagcatcaatccgggagccaaggttttgaagaagaagtaggggaaaatcgagggaacgaagctatgaggttcggctgcagatctcgggaagctgaaaaagagcttggcgacgtacaaagaccagctccacgcaaagcctctgaaaaatatggggtatatcacgagtgacgctgcagcaacagtgacgcttctgagagccccggccactagttctggcagcagaacaccctgtagatacttggaggttggcggtacggggtgagtacgctcgtcatttgttttggagcttcgctccgcgattggcactgcaatgcggtcgtagtcgtagtaaaggtggaacactgcttgcacgcatgctagaaacgcatggaaggaatgaaggtaaatcggcctttcgttcagagtcggtcgctcgtgtggcctgtatcccattagtctaaatcggagtcatttgaaacatactcaacgcaccttccccgtttcacaagctcgaggtttgaatcactcgaagatgaccatacataaatcacagtgaaccaccatgccgagaagatgtaccagccaaaggtttgcgcgatttgtaacggagtgaaggatctcaaggtgccgaacgaggagctagctgttctcgagccaatgtgcatttggctgacccgaaggacaaaaatggtgagcgaggatatgaacagcagcgcggttcggacaccgcaactaccaaagggaaaccataaccagaaaactgcatagaatatttttatcagttctttgtacttcaggacttgaaactgagccttcgaggctcgacccgataaggttgcgatgtaactcacaagacgatttctccccgatcgcaattgcgataatgtaagagaccagcagtgaaagtgcagacgcatgaacaaatcttcggtgcaaggccgaagtcaagattcgcctatagggccgagtttgtacagcggccatgatgtaagcttgagagtgggatgcgctcgtggaagagaatgaaatagttgaagattagagcatgatcagaatgacagtgatatggagagctccgggagctggagaatagaattggcggaccagggacggtgtcgacgaatggtcacggctgacagctgattgtgttgagctggtcggatagaatcaatcaacggcgaggtccgcccaggaatattttgaggcatcataacacaccagccacatatagtcatgtgatatgtggctcaggtgtacattgtgccacagatgctagtccatatcgggcctaatggatgcatagtacgtcatgtgagggcggtctgcacccgtggacacccacgcagcttatcgaaggcagcagggacctgcagataactctcatttggtctccagtcttcttctaccttcactttaagcactcgtttattgctttctgattacacatagaatgtcttttgataggctaaactcgttggaggctcagcctaccactatgcgccgggatgaagacccgcagtaccgtgacgatccggacttcgaccacctggccgagcagctctcagatcagttatttacattgacatcaaacatttctcgcctatcgaatcaaattgcccttctcggtaccaagcgcgacacagagcgcgtgcgcgaacgagttcataatctgcttgaagagacccgtacggggtttagggatgtaggagaagggattaagcggatccagacatgggaggacgtcaatgtatgatccatctgattcaacttactgctggttgatttttattaacgtcccaacttaatagccctcccagaaatggacacagcagaagctatcgtccgaattcaaagccaccttggatgaattccaaactattcagcgtcgtgcactcgagaaacagcgcgcttctgcagttgctgcacgtacagcattcgaggaaggcgagcagccgtccgctgagaacgatgtccaattacaagagcagttattggaggagcaacatcgcatggccaaccagggcgaggtagacttccaagagtctttgatcatcgagcgtgaggcagagatacggaacattgaacaaagcgtgggagagctcaacgagctcttccgggatgttgcgcacatcgttacggaacaaggagggcagttggatatcatcagcgagaatgtccaaaatgtcacccaggacacacgaggcgcaaatgtcgagttgcgcagtgccagtagatatcagaagaatgcgcgcaacagagcctgctgtctgtttgtaattcttgctgttatccttgctattattgtgcttgcaattgtcctcggatagatatttctctttttctcgttctgttattggctaccatcactgtcttcgtctttaatgttgtcatctacgcgcgcgatatccctcttgcatgattacacttcccttagtcaagcatctcaccttttgcttcttttcattctggtacttctgacttactcattcctgaccgaacttcggtgtatgtggaatggagaacattaattcatcgctgtctctcgatcctgtagcctgatatcgtacagtaatatatgtgttgtacatgcaaaatacacccaatcgggtcccagatcctgcccgtgctccgttgtcgccttggtatgtgcagtgcgaaagcgtattccgccagaagacgatcatcaatgatgccttcataaaccggtgaagcggttgaatctcagcctccagccttcataagtgttcagtttgggccgaacatcgaggaagaaactgagttttcccgggttggcattggcattggcagccaggcctgatggtgttccaccattgcctccagacggcttgccctggtagaaatcgataacgtattcaattctttcaccgccacaacgctcaacaacccagtcatgccgatcaaacggatgctggtagccaagccatccattgattcgtgcacgcggactcaggtattttggatcgactccaagtccccggaaagaatataattttggtcctccacatttcttgctcccggggtcagacgaggggccatttctctcccattcgaggatttgatcccatgcacgttcattgacagcattgtgaatggggataatggaggctacggaagtcgcaagctctgaagccgaggcagtcgatccgggagtgttacccttgcgcatcaaggcttcgaaaaactgtttctccgacggatagatccaatttccagtggtttcatcacggccagtctcggattcggcattggatgggctgccatgggacacagcgtatggggatgaagaacctttgctggcctccgggcaagcacttgctgagctgaaatcaccagctcgagggatagtgctcacttcccggtctgttgataggggtcgttgtgatttaggacgatgttgtccctgttcggcagggacatcggaggtaggatgaggtgagttgctattttgttgcaaccagatctcacgggttttgtgatccacgggacaagttgctggtgcctctgcggcgggggcagagggcgtacttgctgcagctcccattgttgaataattggaggtcaatgactggaggagctcggcgcatcgacacggaactagaactacgccgtagaaattattttgccccctcaccgccccgataaatcaacaatccccctaagtagtaaatctcccctcgtgtctcttatagttctttagataattattgacgttctttcttctatccatctgaagcaaaaatggcgtctacatcgaaccaatctatttaccgggccaccaccaccgctccggtgaacattgctgtcatcaagtatgccgctcttcgattacccctcatcccctttataccaaataggtttgtgctaatgaaagtgctctagatactggggcaagcgtgatactactctcaaccttccgacaaactcctccctctcagtgacactctctcagcgctctctccgtaccttgaccactgcctcctgctctgctgcatacccacctgcggacaccctaaacctgaacggcagcccgcaggacatccagtcctccaagcggacaatggcctgtatctccaaccttcgtgccctccgcaaggcccttgaggatgcggactcctcgctccccaagctctctgcccaccctctccggatcgtctccgagaacaacttccccactgctgccggtctggccagctctgcggctggcttcgcagcgttagtccgcgccgtcgctgacctttatgaactacctcagtcccctaaggaactgagccgcattgcgcgccaaggctccgggtctgcctgccgctccctgatgggcggatacgtcgcatggcgcacaggcgagctcgctgatggaagcgatagcctggctgaggaagttgctcctgcatcccactggcctgaaatgcgtgctcttgttctggtcgtcagtgccgagaagaaggacgtgcctagcaccgagggaatgcagaccactgtagccacctcggccctcttcgctgagcgtgcccagaacgttgttcctgagcgtatggccgccattgagaccgccattaaaaaccgcaacttccacgacttcgcggagattaccatgcgggactcgaacactttccacgctacttgcctcgactcctggccccctatcttttacatgaacgacgtctctcgtgctgctgtccgccttgtgcacgatatcaaccgtgtcgttggccggacggtttgtgcttacacttttgatgctggcccaaatgctgtcatctactatgaagataaggactctgagattgtggctggtaccgtcaaggctattctgggccccaatactgagggttgggatggtgtattctacgagagactggccaatgtcaccgctggtgtttccctggatcaggttgactctcgcgccgtcgaagttctgaaagatggtgtgagccgtgtcatcttgactggtgtcggagagggccccgtcaaggttgaggagcaccttgtcagcgagactggtgagatcctcagcactctttaggaagtttggataagctataccggacaaccggtatttccattttggccaaccttggaaggtctgacagcctgaaagataccccaccgttcttgtgcggacaattccacttggccatgcaagcttgatgcatattcctttcactgtatcttcttttctctctcataatctagaacataatcataccatggcagcggggtctcggtttacacagcatatctgcttccattcctcataataatatatcttggacatgacgcaatacgacacagcacttgcatgcaaattaatgaaatgttcgcttccaactttaaaagtccaatatctgtcttagtatacttccatccgacgaatatctcctgcatcctctcaacaagaacgacaatcatcacagcgcctgaagccaaatccgagtgtcctacaattctcaatgaaagcaagttgttcgttgttggcataaacacagcaaccagcaaatccacagccggtatcattgaagcttccaccagtctggacacaggcagactgagagttctcagcgataccctcgcaagcgcatttgatagacctgattggcacttgagcagtcgctagcattcccaagcccaagagggaagtgagatatgttgagaaagagaggtgcatagtctgaatcgagacattaaggaactgacctcagctaacagataaccggacaggttcacttacggttcttgaaaaggaatggccttgcttagggcttttcttggtatcctttcttggctgcagtcatgatattcagatgtgggatatggtcttttttatatctccatcctggatactttgtacacaacgtttcaatcgacttgacaactagccatttaggggagcacaacatatgtctcatttttgcgtcatctagtgagaaaactgtgtctgttgtacgactttatctcgacagatgtagtccatagtatctgacttgattgctccaggtatgggatattccccgcaatttagagtcacatcactaacgcttctctgtatatgaatgacgatagttcacttgtgcaacattatgtagacttgcagttaactctttgcgggtttgtgttgaggacctgtatacatatataccttcgatgccatgaatcgaactacctcagtacaaagaaatatatatatttcacgtcctgatatccaaccctacagactaagcacttattataattctaactacgccagtacaaatgcaaatgcaacgttagaagaatgagcttacgggccccaagtgtaccatattcagtctgttgcgaaaggatgtccactgtgaaaaggcaacgtttgggcccagcctttgtcgagaacagcctgtcgcggagggtattatatttcagttatgcaggtcacgtatgactcgcagaacacaggacagggacccttgagttatctcgtagaaagctgctaggaagtcatacaagtgtaacccgtggattgaagtagatactctccataagaataagaactctgtagcgtcgatgatccgtgccaaaagctgaatatccctttttgtgttcagttcataagagagtctggagaggcctcgtaccgtttggaatccatattgagacggacgttgaatatattctaggtcgctttcttaagctacgtacttttagctggaataattagaacagaagcaacttttctttttcattcatgatgtagatgctaattggtacgtgcagtatattcatcgactgcttcacgccagcaaagaagacttcttcatttccttgacggtagggatctccttaacgcgagcggcaccaccaccctcaacaatggctatactctctttcaagacgccagcacctctgcctccgtacataggagggatggtaggctcgacatcattttcttcatcttccttgtcctcgttctcggcagtggggggaggaacttcaaatacctcgtcccggcaatctgcgcacatagtcaggacttcctgcgatgccttctcgatagcagctgcacgctcacgcatgccacgacgcagcagagcatcgacaagggtctcagtttccgccacgctcgagttaacccgttcaatgagtcgtcggatactgttgacgagatattcttcttcgtaaacggtgcccttcttaccacgagcacgcttgcgttcctcgcgtctgcgagtcttcgaagtatgacgtgacattccagttttgcctgttttcccggtgttacccgtgtaacgggtgaacatggagcgaccagcaagcgtagatgcatctgtcggggccagcgagacgttgtccgggatatcaacgcccgcgtctccaccagtgggatcaccaccaaagaaagcaagagggtcggcagcgcgaagttgacggagttcgctgagtcgtggaacctgggcattgagctgagatctgcagtcggcaagcaggtccgtcatgtcgcccattgcttcagcgaggccagagtcaacgatttcggcaacctggctctgtttgccgtggagtgtaaggagacgcgctgcgtcggcgaacttcgatccccggcagagaagtcgtgcggctgtgacgacgtcatgtaaatgatcggcataaattgttgctgccgagatgtagtctttgtgttcgtcaaccagggttgtgatcagggcgtcgatgtgggcagccagatcttcctcggatagagatgccatcatggcacagtacaaggactcgcgccatttgtgtgccagcttaaagcacttgtaagcactctcataaagctcaagtgactcgtacgctgaaattgaaaaaaataacgaaagttagcttcctgtccattttttcttgctttgttacaaccaaatcacttaccaattgctgcatctttgtgtctcgattgatcctgtaggtagtcggcatatagcttggtgatctcccgttggtgctctgtttggtacttgtagagctcaagggcttccttgtacaagatgtgcttggcaacatatgcactaatctcatcatgagcattcagagcatacaagtgccccagagccttttcgaagcgagaaaggtgattgtcgatctcaaattgacgccgagtctctgggagctgttgtagcttccgaaggaatggtaggtactcgcgagggtcctgaaaattcgttagtggtgagtgataacacaggcaaagcatcccaaggccttaccatctgagcttgttgagcaaccaacaatgtaagctcgaggtcatatacacccaacgcgtgagagtaaagccgctgagcatcggtcaagaaacacatgtgcgcaatagcctcttcagcctgttctggttgttgctctataatacggttagtccttacccaattatttaaaaggacaaaaagagccaagtacttacttctcaggcctgcagcaagtcccagtcctgcctccatatcaggcggtgacttgcaaacatgcgctgtgatcagattctgcaaattggtatcgacacggttctggagagccaccaggaatgcatcgcaaatcttgttgattttgctttcctttttgccaaccttaggggccaagggaatggttgcaccgcccggctgggcgacagctgctgatacattcttggatattttcagcgtgtctttatacagtgtctgtgacacatcgtcctccctgtatgagagttagtaaaaggttttcttatcagactcgatattgacgtacgacaagcgtgacaggaaatcatcaatgtaatcaatcttcttgacttgatcaacaaacaaagtgatgttttccatgaactgttccggggcataatcatgaagaatgttgagatccaccatctgactgcgacacgcaaggaatgcagaccgatatttcttctggtcgatgaaggtacggattccagccaatactagagcacgagggaagattgtctcaatatttcctcgaggagcttggagtatgaccgcgaaaatcgacggtatcaccgaaaccaaccgagagccacgttcaatgctcctgcaccgttcatcagtttctggtgtatcctcgggaacctccatttctgcaatcccatgttagcgtaagtagacatagacgcccaagaaacaatcttaccatccacatggttcagatgaacaaacttcagaagatgcgccgatgtggtgaacaaaagatgagatggggtcacgaggaaagatgtgcagttccttgcaaggactcgcttgttagcatacaaggtgccggttctcgtcattgcaaccaaaatgcgctaccggagttagcaacaagatccaaatacttgggaaatatagtcttacctcatgatcagagatagagacaacacgagcccaatgggtgtcaacattagggctctcgccccatggagcgatatctagatttccagatgacgactcttcaatgctcgagtagctgacaggatgagctggctggcgggcatgtgagaaccacagagcttggtgtccaataccggcgaagatcgatgacagttgctcggagtccacagcctggtatacggattctgtggtgcgagtgtccagggccgtcctctcgatacggctcgagtttggtccgttgtctttaagcacatatacctcgttctcattcaagaacgcaatctgccggggccgactagccggggcatctgataacggatagcttgactcgaggatgggaacaggaacaggtcggctcttcagagaccagagataaacggagaaggcgttgctcgtcagcacagcaatgcggtttccggatttgctgaatgcaacatcaatggcgctggactccaaagccagctcgttgtgtgccatgggagggggtaccccagccattcgcaggggagtcaatttgagagtttctaatacttggatcagtactgttcccaatcaggttcaattggcatacttactcccatcgatgactgcaacagcgccaacatcatccggaatggaggtagacccatggttgatatcaaaaacatagtccacatccaagatcgaacctgtttaaatcagcgtccgttctgacattgctctccgtgcaaggatatcataccgttggagccagcaacaaatcgcaatatcttctcttggtgccattcgaaagagtatggaagcgaagaatttgtatcagccgtgataggaatctcttgcttcaaataccaatggtagttgcctgttgtccagaactgtacacggtcttgaaacttgacagcaagcacagtagaatcaacgttccaggcgagatgaatgcgagaagcccatgagctcatttcttccacagacagacgaagagagaactcgccgtggcggagtccgtttctttcgaagaacaccacatcgatccgatcgtcgcgtcgttgaattccagcaatcaagctgccagacggccgccagctcaaagcgccttccaacccgtcaacgggttcgcttacactgtccaaagtgccctctctcgagtacactctgatcacacggcgactacccgcttcaaggctgttcacagcaacataagccccatctcctcgccagctgatcgtagtgctgctatcgtcgcggctgctcaagactccttgatcgatcttttctggtaccgtcgggtctcgaagagccttggctctctttccttggaactgtgtttctttcttgccccatccgactgacacatgctgcgatgattgcagatcactgtgagcgaaagttatatcggccacattctcaaagtctctggtcatatacaaaaacgtctgcgctctggtggtgagagccagcaattcctcatccggtgaccacactgcagcagtgattccgacatcaactgagccgacaatttcgatcttgtcttcgccgggaaggggctcttcacgaacaacgactatatcacctccttctagcaccagacaagttgtcaggttgtccgcaaagtaatgcagagagagcacacggtcacatgccaggtctggcagagggcacggagcatcccaggaagcaatacattcaaatgcttcgggagacagaggatctgtcgaagtgatctcgggccttttccgtctaacctcaatgattgcattgttctcggccggaccaaaggtgcagaccaccgagtctgaagcagtatcccatgctgtggcagtgagaggcagttcgctctcgatttgcgtctcgacgagacggacgcttcttaagttgcgcatcttccaggaacgggtaactttttttatgtttcttgttttaccccgccatgcagcgatcaagggagtaaatgtatggatttcaaacgatatcgagggaaattaaattccgtggaccagcctttcttccctgctgacagtaactgtctcgttgcttgggagtggttgtgttcgtggggattgatatatgaatcgcgcccagagattttttggttttccacagcggctcagccaatgacttcatccatatttcaacgtcctttttaagctacgcatttcaacatctacacaggtacaatggggtcggtgacacgcggaaccaattttcgataataatctctagctttatacatgatatccgcctctgcttcaatccgatccaagttttcgaccacctagtcgcccagactgttatcgcaagaaaaatgcagtgggaagggcaatttatttggtcttgtaggtttgccagactagtaggggggaatgttagagtattattaaggcgtagaatcgtggagagggggtataactcaccagcaatggcaaagggagtaccgaatccggtaactaggtgatactcgagttagtcctggcacagcgcatatctccattaggggtcactaactcatgaaagcccagtagcgccagaagaagtgcttggtgagagggttgaaggggatgttggtgcgaggaccctcggcgtagtggtaggggctgccgagctgggtgcgagtggtggagaagccacgacgggcagcgaaagaggtggccattctggcccggatagcggaggagtacatctggaatgaagaagtcagtgagatcaattgttttatttcaggttagaggtactaaccttgagtgacagagaggagagagtggacgatcggaaagggacggacgaagccgaagtgaacatcgcgaggtgcggaatgggatgatcttgaatcacgtgacttggattgctctaatcgggtttagcgtctttgctcgggatcttccccaccgcttgcccgatacggatagaactgttaaatttctcaaccaaaaaaagtccagaccggttacctacgccgctcattctcctcctgtggttgattcaccaatcccaaccgctggagatggatgagctctttgacgtctttgaggaccagcctcaggcggtgaagccgtctgagggtgcccccaagcgcttgaagaaggataagcacaaaaaacgacaggtgaatggagccgtgaagaaaactgcagatacccagcctgaacagaaggaggatgttgcgatgagcgatgcacccgccgcagaagtcgactcagcagatgccgaagcccccgcgactccgtccgaaccagagcaacccgagacgaagcgacctcgattggatcaggaacccgagccagtcgtcgccgattctttcgaaaccgagcaggagcgtgagattgcagctggaggacttgctacggacaccgatgcagttgtggtgtctcatcaagtgcgccaccaagtcgcaatcccacccaactacccttatgtgcctatctcccagcacaaggctccggcgaacccagcaaagacatggcccttcacacttgatcctttccagcaggtcgcagtttcttcaatccagcgtgaggagagtgtgctggtgtcagctcacactagtgccggaaagactgtggtggcagaatacgccattgcgcaaagtttgaaacaaaaccagcgagtgatctacaccagtccgatcaaggcgctcagtaaccagaagtaccgtgaatttgctgccgagtttggcgacgtcggcctaatgactggtgatgtgaccatcaatcccactgctacatgtcttgttatgaccacagagattcttcgttccatgttgtaccgtggctctgagattatgcgtgaagttcagtgggtggtcttcgatgaaattcactacatgcgagacgtgaatcgtggtgtcgtttgggaagagactatcattctgttgcccgataaggtccgctatgttttcctgtccgccactattccgaacgccatgcaattcgccgaatggatcgtgaagatgcacgaccaaccctgtcacgttgtctacaccaactatcgtccgacccccctccagaattacttcttccccgctggtggagagggtatccatctcgtggtggatgaaaagggagtcttccgcgaggagaacttccagaaggcaatgagcgcaatcgctgacaagaaaggcgatgacccggctgatgctttggccaagcgcaagggcaagggcaaggataagcaaatcaataagggtggaatcaagggcccgtcggatatctacaagatcgtcagaatgatcatgcttaagaactacaaccccgtcattgtcttcagcttcagcaagcgagagtgtgaagcaggtgctttgcagatgagcaaactgactttcaacgacgattccgagaagaatatggtgtccaaggttttcgaaagtgccatcgagatgttgtctccagaggatcgccaattgccacagatccaaaacatccttccgcttttgcaacaaggcatcggtgtccatcactcaggattgctgccaattctaaaggaaaccattgagattcttttccaggagggtctcatcaaggttctgtttgcaactgagactttctccattggtctcaacatgcctgccaagactgtagtttttaccagtgtgcgcaaatttgacggaactagccagcgttgggttaccccgtctgaattcatccagatgtctggtcgtgctggtcgtcgaggtctcgatgaccgaggtattgtgatcatgatggtcggagaggagatggatccagcagtcgcgaaggagattgtgcgcggtgaacaggaccgactcaattccgcattccacttgggctacaacatgattctcaacctgatgcgtgtggagggtatctcacccgaatacatgctcgaacgatgcttcaagcagttccagaacactggaagcgtttcaggcctggagaaggagctcgaaggtcttgaggagaagcgcgcgaacatgattatctcggacgagggaaccatccgcgaatactacgacctacggaaacaactagacgcatttgcggacgatgtccagcatgttattacccacccaaattactctttgacttacatccaccctggacgattgatccatgttaagtacaaagatgccgatttcggttggggcgtggtgatcaaccagaagaagcgcaagcaagcgaacaatgagaccgagaaatttagtcctcaccaatctcatattgttgatgtcttgatgaggatgtcgggagggtcgtccattggcactaagtctttccaagatcttccgcccggtgttcgccccgcaaaggaaggggaaccgactcgcagtgaggttgtgcccattgtgctgagctgcatcacggagatctctcacattcgcatcatgcttccgaaggacatcacgtcgcccggctctcggaatgatgttatgaagtcggttgatgaagttaagaggcgcttcccagacggtgttccgctgcttgatccgattgagaacatgcagattaaggatgaaagcttcaagaagctgctacgggtaagaagagattcttttgctctcagacattattcactctgctaaccatgtggcagaaaatcgaggttcttgagtctcgcctcctgagtaaccctttgcacaactcgccacggttgactgaattgtacgaacaatacgccgagaaggtggacctgactgcaaatatcaaggcgataaagaagcagattacagaagctatgtcgatcttgcagcttgatgagctgaagtgccgcaagcgcgtacttcgtcgtttcggatttatcaacgaagccgatgttgtgcagttgaaggctcgtgttgcttgtgaaattagcacaggcgatgaactgatgctgagcgagctgctgtttaatggtttcttcaacaacctgactcctgagcaagtcgcttccgtcatgagttgtttcgtgtttgaagaaaaggtcaaggaagcccctactttgaccaaggatgagttggcaaagccattgaaggagatccaatcacaggcccgcatcatcgccaaggtgtcgcaggagtctaagatggccgtgaatgaagacgagtacgttcagagcttccactgggagctgatggaggtgatctacgagtggagtcagggcaagtcttttgcagatatctggtaagcatccccttcccccaaaccaatatgttaacagtatactaactatcctagcaaaatgaccgatgtctatgagggtagtttgatccgtgtcttccgccggttggaagagtgtttgcggcagatggcgcaagctgccaaggtgatgggcagcgaagacctggagagcaagttcgaggaggccttgggcaaggtccgccgcgatattgttgctgcccagtccctgtacttgtagatacgatatcccattttacgatcgctggagtccaaagaatatgattacccacaatttttccttttctttcccgctattacgtagaatgtagaatgtagatgatgcgggtattcgtatagccttgcccgaaagcagtggagtatactttaatctgtcacttaatatgtcactctcgatgaaaccaaaagaaaccttggaagatagaagacgatttgatttatttttctatatgaattattacaaacaagaccaaagaactctctaatggtcaaaatctcttttaagggcacagatctccaaaaagctgcgtaaagggagtgcgttgccacctgcaacgcctactttttctccaccgctacctttctctacccttctctccccacctcaaaaccctttttatcctcttcttcaagcttgcttttcattgctgtttctttttcactcttttggatatccgagtcctttggaccatcacatttattctttgccatccggctgtcatcatgaacagcttggtggccacacctcctgttccgcctcacttctacgagaactcccgattctctccctcccgtatgagtaagatatccctttccccttggaatgatttgttctctctgtcctgtttaagatggttgtctttgatgcattcggatactgaccaaaccatcagtgtctacaccctcgtcgtcgtattccagccgtaaacggaaagccgacgacgacaacgaccatgatggacgcatgtctgcttcgcccacaaactctcccgcctttactcctcgacaactccctcacagctaccgcaacatcaaacgttcccgaccgaacgtttcaggccgacctctatctctcccccgtttgctagagaccctcgatacagatgccttgcggacggttgtacggaccatgtgcgagcgtcaccctcaactcgctgacgaggttgtgcatacatccccacggcccaatgtctcctcaactcttcaagtccttcgaaactatcaggccgccctccagtcctcattcccgttgggtggcaataccgaatctgactatgcctacaaccgagtccgacagccgctcaccaaccttcttgacgccttgagtgacttcacccccaactttcttcctccgaatgaatcccaagcatccacatccttgagctacctagacggggcaaccgacatcatccatgccttgcctcgctggagcacgccacagaacaacatcgaacgagattcagcttatgatgagatgtgcaaggcatggattttggtcatccgggaagcggcaaaaagaggcggcggcattcagttgcagtacggaggttgggatcaaaagctggccaagcacaaccagacttctggaggaaagctacagggggctgtcaacgaactcggcttcagcttgggatggatgaatggacccgacacaccatcccacggagccaacagcgagatgggctctatacgggaccagctcttctccggaacttatgggctgggaacaccagtcaaggtcggaccttggtgataaatcacgccactccgattcccttacgacacactaccattacatttacaccgctcttgcgtgtcggcctcacgtccccccatccgtgccggccctcttttgagcttgaccgacggtccatacccctttgaccgcgcaattttcgacgtatgtcacgatcacgatacctgctgcatgaccctagactcaacatggtcagatggcgttatagtactcaaggcggataactacagctttttttttttctttgtctttttcggctggaactctggaagatgaatgctgttatagctttgttttcaaatttttcaatgaactcagactcagtaccttttcctttcttccctactttgctcatttatcgtattccgatttatgcgcataaccttccttttctctttgctttcttgtcagaatctcgaatcctttcatctgtgtatttcattccaactctgatactctctttctatatctcctggcgccctggtgtcgcatacatttccctctttcattccattcatgtctccttgtctttgtcttctgcgttgctgtcagttgtctttgcgcgtttcactttggggacttggactcggtctctcaattgcctgtgccatccaaaccctcacatattccaatgatgcgtatcaaggcgacaacgtctgtccggccatcgaacccaatccttgtgctttccagctttggaaaattcgggggggggggggggggggtttgaacctattctatacgttaggagaggaccacgcgccatccaacctggtctacaacctacgttttgatcttgtcatatcgcgcaacatatttttgatacgttgttagatgatagggccctttattcgcgctagcttattatcattggaatcctgtcaattttcttagagcttttgttcattgggtaaaaagcatgcaacaacgaacgacattcccctattctcttagggctgctcggccatgtattgccagcttcatagatattctgaacaaaactgatagatagttaccgagagcagatcaaaacagaatattgtcacagacaacccatcccaatcaaggaaatcgctcaatgcaattcataattcataccaacgcccgcttcattaaacgaagcaaccacccagcatcttcccacccaccctgcgtcccaggcttctcaataggagcagcagtaccagtggaactctccccatcagacagatccccatccccaaccgacccaagcgagaccgtatcatcagcccgcccatccaccaaaacaggttcctcaaatgtaacagtagtactagtatccgccgtaccaatccgcgaagcaggcacagcagccggagcagccgcaggccactcatcaaccccgaaaagtgtccactcaaccaaccgatcaatccaagatccaagcccgaacccacgctcacgcgtcaactgctgcagatccgcttcatcgaaatcatccggcatctcgtcagagccacccgagtacacagaccaagtctcatcttcatccgagccacccccatcccagtacatagagtcttcatccgggaatcctcgctcgcgatgctgcagcgacgccatctctgcgcggatgcgcgcatccacgaagtcaggcactagtggactacgaccgcgcgcttcgggactcgccgtgcgagtcacggtgcctgtatccgtgcccgagctgataggtacctcgttcgctgctgataacggtacagccgggagggcggtcatggttagatggactctactactgccgggtctgctgccggcgcgggagcgagagctgcgtcgggagagggcacctgctccgcctggtgttgaggcaccggagcgagaaatgcgtgacgagacgcctgatctggtgcggtggtggtggcggttagtgggtgtttcgtcgaaggaggtgtctgggacgagggttgttgaggtctcgcgcttggagagccagctttggcctttttcctcgcgggttgaggaggctagggctatgcctgcgcggagcatccattctgcgtcggatttgggtttcggggtgttgtctgggagggggcgtcgtccttgtgaatgggagatgctgggatgctttttggtgtttgggatgtggtggagcgcttggcctagttcccggttgtgcaggttcgtgtcgcttaaggctcctgtccctgtagagcttttgctgcgcttgtggcggcttcgcgagttgctgcgtgagtgcgagaggatcggtggcgtgcttggtactgagacgctggatagataggatgatgttggaggtgtgcgggtgccgctagctggagctacatggtcgcggtgattgaagtaatctgttatatctgtgtcgtcgtcaatgggaaatcggggggttaagggtgctagagatatgtggcggagggatgggtatgagcgacgggactggaagcctcccgaggtggtgttgaactatatattccacgttaaatctccagttcatgtttttgtctgggtcaaaatctagtacttacctccatcatgagtttccaggtgaaacctcaagcagaatgaaagaggaagaggtccagacggtggaaatgcggagttgctgcacgtgcggttggcatgtgaaagacgccggcaccggcaattatgctgaagatattatgcccgaggatagaaatacgttcaatagatagaggtatactgcgtgaatggtgcagaatgtaaataagcagaaattgaatcagtgatagctggccgatatatggaagttgtccaatattacgacgaagcgcagttgtacagttaaatcatacgactacatatgtatacattgagacacgatgaatgcccgtttggtgcaaccgaactggatgtatgaaaaactagagctgttcatttctatctacaaataaccatcaaaaatatctacgaagtataccaacatatatcggaaccgcctataggcgcgaatcttgcaaattcaaatatccctggcccttgatcttcaagtcttctagaacgttgtattccataatccacttcatccgctccatcagcgcatccgggttgaagttgttggacatctggtcaggagaatctgagctagcgagcttgccagcttcgtaactggtctttgtgacccggtctgtccggggcttacgcaggtcctggtaaaacttgaatgcagcctctaggtcatctgttttccaatgtctgagaatagtggcaagggcaatgccagattcaattgccatgcatgttccttggcctatagtatgcaattaattagtacacgccccgcaataggactagatacagatacaatgaaacgtaccttgatgaggaagagtcgagtgcgccgagtcaccaagcagaataataccacaatctttctgcccgctcttcatctcataccacttatcgatcggatcacgcacgtacagcgcctgtttgagcatcttgccgtcctgggagctcttgcgcagaccagcaatgatatgctgcacctccgggcaccagtcacggacgtgctcctggagagtgtcaatatccgagcgggacatccagctctccgagtcccaagcctcaagtgactcggacataaaagcgaccacggcagcacggtcggttcccgtctcctggttaccaataggcaagatcaggacatggcgcttgggcccacggaagttaacagtcttgcgcagcagctgtgccgtctcagcgggtaggtccttgtagtcgacaaatccgcgatacacaacctggccagcgtagatggggtcgtctcccaggcccatatcccggcgcacattagacttgataccatcacagccgaccacaatatctgcttcggcggtgctgccatcctggaaatgaagtgtgtacggtgcagcaccggccgcgttgcggtcgacggataccagatgcttgtccaagttcaggcttgactcgggtacgcgctccttgagcgagtctagtaggtgggcgcggtgcagcaggcgggcgtgcggctgcgagaactcgccaatatgacctacgtagtcgccggtcttgtagttgtggtactccatatagctgggcagcttgcgtgaggacttgcgcatcatgctctcttgcagaccgaaggcgtccaagacgcggtttgcgttcgaggtgatgtttacaccggcaccgacttcgccgaactgacctgcttgctcgtataattgcactttcttcagaccggtgtgcagtgcggcattgaggaaggacatgcctcctaggccgccgccaatgattgcgactcgcttgtcttcgaagcccatgatagcgaaatatagaggaattcggagacactaagaccagagatattcttgaaggaatgatgatcgatactccaggttctcgggcgagccttatgtatagtcgctcgggcttcccccgtgaagcattacccgatcaaccgtcttggagatgctcttcggagcatggattaaatgtggggtaagcaatgattccgagattctacttcggatttcccgagttccagcagacgttcatgtggaatacatagtacatatgtggattttccaaatttcgagattcgactcggggttatgcatttcactggaatatgctttcaacgtttgattttatacttgcatactctgttttatattacttgcagttcggattcggtaatgcgaggcaactcccgaggaagaacgcagatattgtacctactagtgtatgtcttggtatagccgtatgaatttcagacaactacctacctaggtaggtagcaaatagtgtattatattgtatagtccgaatgatctgcagaacagaataaagtcgtagatgtctcagaatcggaagtccccgctattgtggaggagccacatccgaaaaccccgagctgtcggaccatcttttgattggctcaccagcaacggacgactctcggagaccctcggactctcggtattggtgactccgctatatcaaatcatcatcactgtcattggccgggtaaagcgactcggcatacctctatagactccatatgtatttaaccggtttttctactccacaatttttcccttgttcacgacgaagccctccaatgcggcaatagcggcccacaaacgattttcggcttcagggaagacaagcgagcgaggactgtagaagacctcgtcatccacttcctcggggtggcggggcaggcagtgcataaacttccagccctccttagcgccaccgcgcttagccaaatcagcagtgatctggaagccctcaaaggccttcatgcgcttcttggactcctcctcctggcccatggagacccaggtatccgtgaccaggatgtcggcgttcttgacagcttcctcgggaacgttggtctgagtgagcttgccagccttggagacaccctcaccggcgcgctggatgatgtcgatcatatgcgcagggatttcgtagcccttaggagtagcaacagccatgtccacacccatcttagtagcaccaatggcgagatcgaacagaacgttgttcgcatcaccaatccaagcgatctttagaccctccagacccaggctggagagcttgtgcgcctgcgatgggaaagactcgtagatagtcaaaaagtcggcgatgatctggagtgggtggaaggagtcgcacagcgcattgattacaggaacggtggagtgctgtgccagacccgccacgtcctcgtgcttagcgacacgcgcgacaacgcaagagaccatggaggaaatcacaacggaggtatcgtatagggactcgttgacaccaagctggatgtcatcctttccgaggaacatggggtggccacccatctggacggcggcggcttcggtggatacacgggtacgagtactgcgcttgttgaacatcatggccacggtcttgccagagagggatcccaataggctctccgggacagcgccggacttgatggcacgcttgtgtgacgcagcattgcggactagggtagcgaattcggtaggggtcaggtctgcaatggagagaaggtgacgaggggcgaaaggggaggtgggaggtaaagtcggtgtctggtgggcaaatcgtcggattccattagcctggagtgttcgacgcaaagatgaggtagagccggccaattggtttacactttgggcaccgtagcgggcggcagctgtgagaccactagccatgatgagctggggggattcttgatgaggaattggagtgttgtgggaaagagcaaaggaaaaggaaaagggaaaggggaaggggagccctaaaagtaaagaaccttggaagagtgactcaataaattaaggtggatgcccccgggtgtgcgagggtattgatgccttgtcgcctaatattccaggtgcgaaggtgtgttctccacagttccaaggttccgttatcaggcttatcgtcatcgagggtccagccagcctcttccaaggttaggtacgtctcgcctctgtccgtctttctctgtgttacgtgcgtcgcttccatcccttttcttccaactggtatatcagctccagataccacaactcattgtgattcatctacatctttagggccacgatggctgacgaggcaaaccggcctctgctagctgggcagtcgggctccgagagtgtatccgatgaccggcccaggccatcgtatcaattatccacagagttatcaaatgttttatactactctgaaagtaactcgacggtccatacaaccgaacaacgaatatcacagtctcattcaggcggggctacgatgggggatgcagcgaaccgggctctgttggacgagcaatccagccctattgaacggtccccggagagaacatcctccgaccagcctaggccatcatatgaattatcgtcggaatcaacacctctcttacaccgccgtgatgatgaactggcctacgggactgagcaaggattgttacgatccccttcagtcgcatcacagaatccgcccgaggatggcgccatcgacaagcggagccgtgtaccatggccgacggtcatttctctctctattttaactctcggtgttttgacgatactggtacttgcctttgctgccccggcggccgtcaaagagtatgcgcagcacgccgctgtcttcaagccgacggcagtatcaatcgattctaccacacccgatggcgttcgagcccggattcagggcgacttcgtaatggactctggtcgcgttaagaataagtcggttcgaggcattggtcgattggcgacatggattgccagggaagttgagacaggcccatcaaaagttgaagtatatctcccagaatatgggaacgtactcgttggaaacgcagcattgccttccatcaaagtgaacatccgtaacggccatcataccaatgtcgacttcctcactgatctagaggctggtgacattagagggatccacgcggtagctattgattggattgagggaagattgggtcgccttaatgtcaagggcaaggcgacattgaatctcaagtcaggcttgtttgctttaggaactcaagtcctgacagacaacatcatcattggaggtatagtgtatttgttcgtttttggtactggaacatataagctaatctctttccagaacatgatttccctgctctaccaatgatcaatatcctcaagctgaatatgcacgatgcaaacagtggtgggatggcagtggatgtcttactgtcgtctttgattgattctcccgtcgctctcactgttcctgccctcgggtttgacgttctggtgcccaactgctcccctggagatccttatattctggtcgccgatgcaaagacaagcgcgatagacgttcaccctggccaggaaactgcggtgggtgttgagggtctcattcaacagctacctgatgaattgatctctacctgcccaggacaagagggttctcctctggatcttttggtttcgagctatatgcaaggtcttgaaacgaccatctacgtccgtgggtccgatgcaccatcactcaataccccagcatggattgtcgatctactgcgcagcgtgactgtgcctcttccatttacggggcatgcgttggacaacctcgtgaagaacttcacgatgtccgatacacatttttcccttcctaaccctttcgcggagccagattctccagactcccgacccacggtgtctgcttttgttaaggttcttattgctctaccggaggagatgaatttccaagtagaagtcccgcaagttcgtgcccttgcagatgtctactacaaggaagagaagtttggtgttttaaacatcagccactggcaagacgccaactccacattggtggatgaccaagatggctcctctgcactccttgtggagttcgcaatcaaagatgcgccgttagaagtcacagatgatgggcttttgacagaagtcatccaagcaatgcttttcggtagcgaaacagtcgtactgcgggttgctgccaccgtagacacaaaggtctcgactgggttgggccgtttcgccttgcgagggattcctgcagaagggaatgtgcctgtgaagagtatgttttcatgaattagaagatcttagtacaaatcaagaatatttcgggcattgaccatgtcatagcttccgtcggcaactcgcttgaccaagtcaatccgcgcgtcatctcactgcaactaggaaacacgactgaatcttcgatgttggtgtccacgctggtcaacttcactaatccaacgaattactcggttacagttcccttcgttgaccttctcatactctacaatgacactgctgtggcccacgtcaccgctcagaatatctctgttgggcccggcaacaacagttacgtgcccatcgacttcttctggtgcccgtcggacgcagctggagtagatggcattgaggcaggacgggcgttgctttcgtcttacgtatcaagtcagttccttctgggtggcattgagccccaactggtagactgtgctgaagcttttactcaggttttaatacaacaatcaccatcaaaagccatcgaaacacgattccatctctaccagacctgggcgaagcattatcaattctcaacattactgttcctgtccctcgcatatctgttcctggcagcgatgacaaggacacaaagccccatttcatccaagatgcaacggtacgtccctttcactcataccgcatctctacaggtagagaagagaaagctttctactaacactaactcacaaatctagttctacctctggacctccacagcagacttcaccctctcttcacccctaacagaaaacaatatcctaatcacttcaattgacgcaacggctttctatgagaaaaaggagccaatcggccgaatcgatgaccatgaaccctttgaagtgccgcctggcatatccaagagcccacgcttgccagtcaatcttgatatgggcggagttggctacgatgctctgcgcaaggcactcggccagtcattggagatggatgctgtggctaaggttggcgtgatgattggaaactacatggatatcattatctaccatgggaagggcattgcggctaaagtgaggatttagagtgtagttgccacctcctgtataatggaggtcgatgtcttgcttgctgctggatcggcaatgcttaggtgcccatgatatatgggtgactggtagtattcggaatttacaaggttgaatcaattcccggctatcagaatatatactctcggtttacatccaaagatgaaacaacaagaaaatcagatcgaagtacgagtaagagtaaaggaagagatacatatatgcccaggacggacttgtatggctccagaagtaatggactaacgcctattttctagtccttctgtccaggtagggcttggctgagggggttatacctcataggtccgtcctatctagataggataaaagataaaaaggatatatatatataaaaaggtcaaaaatccgaaacccccaaatctggctggacagtcatgctctacctacctagcttgctccctcgttccagcgccgtgtcatccttcttgctctagggctgagtctccttcaatgttgatcccaagccgttcccttgcttctcattgggatgccgtcttctctctcattcttctttttttctttcccttcaagtatataatgacatgctggaaatgttgcttttgtatgagtaatacctgatcggctattccaaggtcgggagtacctaggtaaatggtggagtatgtacaatctccgatctaggaaacgccccagcagacgcggaatatcagaataaccgtacaccgccactttgtatcatcactgaatcatacagcaaggtgtatggggacagtaaggaattgtatgtaaaagtgagggaaacaacatttgtgtcattttacatacaatggctaagccatttatttattttatattaggtcaactccacgggaaagccagaagatacacaaagccaagagaccaaaccaatcctattcgggtatgtaagttgtgggttggtaattcggatatagcttagccagggggcagggtgctggcatcaacaacgtcggcagcatccttctcgatgtcctcgttgggctcactcagaggagaacggggaagggccatcagaccagtccgggtggactcaaggataccgaagggaccgatcagcttgaggaaagagtcgatacgggaaggcttggcagagctataggaggtcgaatgagtcaattgtgatcaaaaagaatgaggcagaatagagaaaatacttacacctcgacaatgcagttgttggtgctgatatccaggatcttaccaccgaattgatgagtcaggcgggtaatggcatccaagtgctcgtgcttgtgacgcagagcctgactctggggaagatgacgggggtggtattgctgggcggtgtggtcaaggctgtggtgcttgtggtccagggagtctggcgaggtggtgatctcgcggtggtgctggagaagctcctcgaagaactcaggaccaaggatagagaccttggccaggagaagctcacgctgcacaagagcggagtcagtgtagtccagcacggcccagacagggacaaggtcgtcaagctggcggcgagcctgctcgacaacgccatcctggccctgcaacacgatggtcatacgagagagatcctcaacctcggtgttgcacaccaccagactgtcgatgttgaaaccacgggcggccaagatacctgacacacgggacagaacaccgggctcattctgcacgaggcaattcaggatgtgccgcttgggtgggttggagggaacaacgggagtctcatagagaatggaggagacagcggtcggagcatcccattgaggagaagcatcggagaccggcaggggcagaggggatcgacggtgcaacgccttgtaggcaagagctgaagttgagctcgacgatgcacgaatagaggtgaatcgaggaatggcagcagcgcgagaccgggcagtagctgtagcagatgacagcagcgacgctgaccccagggacagcgtcaatgggcgccggaaagccatgaggagttcaagaagtgtgaatgagttgtgcgatgattcactccagattcgccccgggtatattctttttaatcggccgacctcggcgaccgctcgctgactcatagggagctagatccaaagcggtgtagtgcatccgccagtgataagatcacgtggtaaatatcacgtgatcctcaatattcaacatggcaaaagggattgccagaaaacccgaccagctcttggaaatgagaaatatatagtatttctagctattatcatcaatttgagcttctcaatttactcaaaatcctctcggttttatcttttgtggctttgcttgttgcttgcttggtctccgcctctaaaactccttcccgcaatcgatctggacctttttgagcttcttttccccgacctttcctctcccttttcattctaccccacctttcaccatggcggacgatgaacaccgagttaagcggtctcgctttgaccaaactgagcctgagccccggcgatcccgttttgaccgacgctctcgatctccatccaacagacagtcggagtcggcccgcactcgtagtccgctgagtcgcccgttgagtcgcagtcctggcgcagatactccagcaaagccatccgcagcggatccggccgccgccgcaggtgcgttgtacttgggtttacactgtcatgaatcagattatgtggctaaccattgtggtctctgtagcggcagcagcagccaagattaatgcgcagcttcaggcgaagaagggcattcaacatgttgatgtccctccaattcgttctgtgaatatacacccacttcgattggttctacccaacttctaacatcgtccggacaggccgacaacgcgacagaggattccaagtcgccctccgccgagggtgcagcgaagttgaatgccgaaatctatgtcgcggatggggactacattaaggacattgagatcaatgatctgcgcaatcgttacaccctgacaaagggatctactcagaagatggtaaatatctcctttgtcacttgctgatactccagccatgttcctcagaaaattggggtaccatgaatcttggtttctcaccgttctgctctttcctttcggactggatgaagcttacccttcatagcatccaattcaccctctgttgcatctgctgacctccgctgcgtgacttatagattcaagatgaaaccggcgccggtacgacttccttttatatcttcaactttaggcaaagaaggtctcactcacttatttctctctcaagatgtgacaacccgaggcaattattaccccgacaagaacatggcgactgctgcagtaaggaatgccctccaaagattggcggtatcaattgctgactattctgattcagagcccccccctttacctacatgtgaccagcaccaataaggatggtctggagaaagcagttgctatgattgatgacctgatgcaaaaagaacttccgaacttggttgacgagcgacgattccgtcgccgggaacccgagcagcaggttgagagggatgagtatggccgtgtatgagactgttcctttgctctttattagtatagtaatttggctaatttcataaagcgcaaatggccggatgagcgtatcccgatcgatcttgagccaatccccggtttcaacttgcgagcccaggtcgtcggacagggtggtgcttatgtgaagcacatccagcaggccacccgttgccgtgttcagatcaagggccgtggctctggcttcatcgaatcgagcactggccgtgagagtgatgaagcgatgttcctccatgtggcgtgagtggtcaacaattttcttactgacttcctttctcacttgtttttttttttgcctcgcttgtttctactatgagcttttactaacggcctttcaagtggtcctgacgccaacgatgtccagcaagcaaagggactttgcgaggaccttctaaccaatgtcaaggaacaatatcagcgtttcaaggagaacccaccccagcacaactacggtggataccgcggcggtgatcgtggtgatcgtggtgatcgctaccaaggtggaggtggtggcgctggatatggcggtggctacaacaatcgcccgcagcataatgcttcctctgccagccctgcaggccaggctgctgctgtttcctccccaagtgcttctgccacccccactgcggccgactacagtgcccagtacgcccagtactatggcactgccgacccatatgctgcctacggtggataccagaactacgtcgcatactaccagtactatcagcaaatggccgccgctcagcagcagcagcaggcagatggcactgctccctctcctgctccggccaccgaggcccttcctccaccccctagctcgggatccccgccacctccgccacctggtgcgggtggcagctacagcgcggtacgttattcacgtgtcattggtagtttcgattactgatgaattacaggtccctccaccccctgggctttaagccagaacctgttttggtgggttaatgctgtgccttccactgtccacttgcagtccatttgatttacacggcgaacaaaagcatgtcctggtcgtttgcaaaaacgagggtgacacagcgattacttttcgttaatctctttcagatctctttgtgctaaagaaagtctagcagtttgccttgtgtctaaccctttgatctacctatttccatactcggtaaacttgataattgtgttcataataaaaggcttgcttattgacagtgaaactcttgccatgactaaattctttaggcaagcactggttgctaagcggcccggatgctggattccatcggtttcttgtggtgtatgtgaagtaccaaaaaaaaaaggaaagaaaagaaaagacccccttcctacgccatccatgctgttcgcgcctcggaaatgcaagcaggaaattcgacagaagtaacaagatgacaagaaaagcaaagaaaacactaaatcatgcagcataatctaaatagatgacaatatctctcaatcgaaatccgcatataggagagccatctgagtctcagatgccattttctcccggcgttttgccaacccggcacgaccctctttgcaaaaatcgcaggcaaagtcgcaaggggacgagctcgtaactgatacggcctccctggccggcagttgggaccccatttcttccagctcgaagtcaccgaagaactctttgatcagttcatgtctacacctcctgatactctcacagtatcgaatgaccttgccgaagctttcaagcttggcctctcgattttcggggccattcgcacggtgagattctgtatcccggtagatcatggtctctatgaagttcctttcttggattccgtagtagacaagtgaggcagcggcgcggccatctcgacctgcacggcccgactcttgaacgaaactttcgaagcttcgcggtggcgtccaatgcacgacaaagcggacatcggggttatcaattcccatcccgaaggcattggttgccacaataatggagaaaacgggtgtcctttccccatcagctggctggactggccgagacgacttccatgttgattgaatgtgcgcacgcttggtggcttccacgccggcgtggtatgccacggccatgaccatttcgtccgaggatagccgactggcaagatgctcagccatagcccgggtccctacatagacgattcctgacattggagggagcagtgtcactctgctgccaagtcgggcctctcgtcgggttcggatgcccttaagccatctgagcaggttttgtagttgactgtcttctgcactgtcgctgtcgccagcgaaatctgcgagataccgtacctcgtagtgaatatttggacggtccgatggagtgttgaacaggcggagattctcaagatccaaccccaagatgttgatcatgtccgagcgaactcgcggggtcgctgtcgctgtcaaggccgtgattgggacagtcggatcgacgagattccttctgaaccagcccagctctttgtaagctgggcggaagtcatgaccccattcacttatacaatgtgcctcatcgatggcaacgcggatgagctgaccttgtttgtgaactatgagcagacggcggcggaagttgtctgtctggcacaattccggtgtgacgtatagaaggcgtgtgctcgggtggccgcaaagcatgtcttcaaaaactcgctgtctctcatcatgagtagtattggagttgatcgtagcgactgccacaccaagagctttcaatgtatttacttggtcggtctgttagggattagctatttgattgcaaacgtcctggaaccaccctcaccatcaatgagagaagtggacaaacgacgacagtcactggagatattgaagtcagactaatatgtcagaagatacgagatgctgaaaacccacagccccaatctttcagtaccgcggggagttgataacacaagctttttccgaacgaagtgcatgcttggagaaagacatcgtgtccttcaataacggatgagatcacttctcgttgaagtggactagttatgtggtagtaagtaaattgaccgtcttctgtagttcgtcaactcaccggaaatcattctttttgaaggtgtgtttcaagacccatcgcatattggcggtttggcgcgtcaccgccgggttacgatccattgtgcctcatggcagagatagatgatgatttaaggtggtaggtgaaagtgtagtcgaagaagattgagtcttcaatcgcgtcccagaacgcgctgtcacgtggtgacctcttactcccttttcgggattgattaaatttgacttgggttcacttttgaaagacttaataacgatataaagaactagagtctacaaactgggcctggtatttatgtaaaataatacatttgcacaaagacacgctagaaatcgaggcggtatatggcagatctatatagaaaataatgtacaagtgctgaatccaaatttcagctgctcctctttcttgttcagcggttccgatggggatccctggacatctgtttatcaagctcttccttcacggcaaagacatcaaccgctttgcgctgttgtggatgccaaagccgctcaagttgcaaccaaacctcgaggacctctttgggaccacaacatgttccaaacgcttgcaggataatggtgatcatccgacgtccaacaaaaagaccattttcgagacgctgatcaggatcccagttttcttcttgctctgcttcgctgggaacctgcaaacgagggttgaagacctcatctacatcaagttcctctatttctgtggattcatcttcattctcatccagttcaggctttgcgtcttgttcggtgtctgggaaatcatccatggcggagccctcggcagtttcctcggatccctgtgcgctcccagctgtatctgctgtcggcagagccaagtacaacccgttgggggcatcggtcactggtagctcctcgacctcgatcgccacgctcttagccagggggttctcccaagtcatctttcggttgttcaaatttaatccacggagtctcgcatttgagtcgcgcagagcccggatgtatgcatgccatgtcagccgaaggttttccgcactccactgctttttcctccgaccatgcagagcgaacccttcaaagaggaacagatagattatagaacgtggtgggacggcaaaagttttctccatgtcacgcataacagccatgaagctgtcgagctggccagtgttgtaggcgtagtgtcgtaggaagatataaaatgttcgtgtgtcgggcgcaatagagagggaatcctggagagcacggtggtattccggaaacttctccttgagtgctgacgacttcttcaatacacggcccagctttcgggatctttcccggtattggggcatgtcatagctcagatttgaaccgccgatgtgaaagggggatccatcgtccgaatgcgagatgcatttgtttttgcttgattctttctccagcatgcgtgcatacagctgctccgcagtttgagtgtcgcctgcccgaaggaaagaggcaatgaggcagttcatgacaacggtgtcgacgatttcgcccgatttcacaaagtcgtcgaaagtctctcgaataccttcaacatcccgtatcatcccaaaatagtagattttggatgtctttccgcaccgtgaaaagctcagaccgcgcttcgtcatttcctcctccagacgatcagcaactttgaatgcactggctttgattgcgatgtcgaacaggatgttgaaaaccacttcgtcagccttcactccagcgatgtgttccatcttctgccacatgcccacggctcggataagatctcgtttcaaaactctgccgttggctcggccagaaagatgtatcgcggaagaccagagtgagcgggataaaggaagtcgagcagttaccatgtcgtccaccaatgccaagtagcgacgagcatctacccaccgtcgatcccgcggatgcgcgaacaaacgcaacagagcacctcgcgtgcgttgcgaaagcaaagctaccccgggggcaggaagatctctgtataatcggaacaggtattgggtggatggatttggctcttcccacaacgttctgacaagcttctcaaccgagtggatttccatttgatcgtgcgactcatctttgtacgtctttttgtaacgcgaagatggcgccaccgcattcactgcttcctcccagtcataatctgccaaggacctttcgtacagcttcgagatagagagatgtttctctttctccggatggatccatgacgggaaggattggcgggggtatttgtccggcaatttggggtcgatgtcggttttggtgtattctgttatctctagtctgcggtcgaaatcgtatgtaaaatcaaatctttcacaacggggttgcgattccgcgtccgcattctttgccggccacaatggtatatagtcgttgtctatctccgtctcatccggcgactcggtctcaatattatactcctctgcattatcgtcattcgtacgtgccaatccgttgctgatcaatcttcttggttgcgacagatgaaaccttgagtttgaatactctggctgtcgtcggggtggtagctgtctgcgaccattggcgcctttggtttggaatttttgtaaattatggtccgaggaattccaggctactgtcgacaacccccgacggttcggcgagtgttcatggcagaagcttgccagaaccagagagccgacaaaaatatctgctattgacgcgacggacgggcgaggacgacgggtacagagtcttcggacagaggaggtgtgaggagggggtttcgagggagacattgaggtctgtcgaaagagaggaagctcatccaaggcctgcttggggtgaattcgcaggcttggcgagctgggggacctatttgaatgaggcatgagatgacagacatcgtggcattaggtagaccgcatccaagagaaagccctttgcaactcgcacaagagagagccgtctactttccgggcgcaaaaagcagacaaaaggggagagggtcaagattcggaagatgcaggtgtttttctgaagatgaacgacctgcactttctgggcggagtccctccctcgaccaatcggagccacgctttgccaatcccatctttttcgctcccgcatcaaccacctcgtcccctgccagcgcatatcttgtctttctttatttgctgtctccagtcgcgtctcaattcttctttcgtttcaagttcgtccagctactggctgcgtccgactatcatgggcaaaataaacctcacagccctccgggtgcgacagacagcactcaaccaattcgccagtggaaagaccagcaaactgccacaatgggtcggtgtggtcggcgagatccctcctgctgaaaccctcattcgtacccgcccccctcagcatgagcttgtccagcagcggttgaagaccgttcctgggtcatcgaagccgcaggtcgtcttccaagtccaagagaagcgcagaaagcccaagaagcctagtcgacttttccagcctgtcgagctcaaatatgaagaagatcaattgcgaactcaattcttccgcgatcacccctgggaacttgcccggccccgtgtgcttcttgagagtactggcaaggactttgaacactacgattggagccgcatccaacagccagggaagcggttagatggtgaaaggtgtgttcccaatatttcgtgttctaatgctttgttttattccatttgatttttcatgtaaatcttccccgatgctaatgtcttactttctgttactagtgttgtccagcggcagctgtggcttttgaataacgtcccggatatgaccaagagcgccgcatacgatattgctcgtcgagaattctacagacttcggttgaaggaggacattcaacgtcgggtggctgcggaagaagccgcggcatatggcgcagagttcggaccatcatacttggacattggtatgaagatggagaacgagcagtacgacaagtgggttgcctgggcccgggaaacatctctggtccaggaccagcggaaatcagctcttagcggtgcaccagacctgggagacactactgagtcaagtggggtcgaggccgaagaaggagaggcggtcactctgtaagagtctgaaatcttcgagtgggctcgaatgccattatgctatgcttccttttccagaagcttttgaacccctagactttcctattgatggcctatgtatattatttgatctgttctgctggatgttgtacttccctagctctatttacgcgatagcacatgcattcttggtcaattcccttatcattctagtttatgcatcgtagatcctaagctatcactaaatatgatccttgatatctcaatttcaatatagtgacgcaggcggagtcgggacgcagagttgcggagatccggtgtttgggcgtgtttcacccaatcagaagatttccagcctcgccaacttgaatgtccccaattcccttcattccaggaccagaacttgatttcgttttggttactcgcgtcagccttaagacgcttgttgattcgatcacattcttcggcctgccagatctccgtcgtggccaatctctttatcgcgcccgcgattgtcaacatccgtgagagcttcattgcactatttcccccggtcttagacaaatctgctctgaactcaaccatttgatacccgactgcttcgtcacttagcgattccgattcttcttcctccaatccgactccacggccgcctcgagctccgttccctgtcaaacctccagatagcccgcccctccgacttgatcacaaccaacgatgctttgcgcaggtgcctgaagtgtgcttatatggtactggtggctgaacctggacattcttttggcttttaccaatatcaattcatcaacgagagtgctgcattggggtgtctgatcaacaacattcgggcttttatccgccatgacatccgccatggctcgttccgaggacacaatacgtggaccgcgcttgcaccgcggcgagatagatgaagacgaaacggacaatggaacgccggagccgagtagcttcctggcgtcacaaaacgatgactctccgtacccggatgaggaaagtcggccaagcactgctttaggagatgcgtcagagagtactagcaagcaaccaactgggccgaaaacacttagccctgaggaaaccattgagctagcgcgacatgccgttgaaagtggtattcaggataccaagcgttcattagcaggcagtgaggccgttacggacgtggtcaagcctaagctgaccattgaccttggccattcacaaattgccaggatccctgaaccagtcgttgacttgatcaaggatgaggtcgaacggtacgtcggagccttggattgaactgttatagtcaaatcttgcgttgccagttcctaggctatagcatcattgctctgaactatactgattactataaaggctgtctctgtcgaacaatcagcttttccatatcccctatcggtttgcagagtgttcgcatctacgctatctcaacatcagagcaaataacttccgtgaattcccaaaaggagtaggtacaatgataaagttgctttgtgcttgcattgcgctaatcctgcttgctaggtttacaaactgccattactcgaaattcttgatttgagccgaaataagatcaaggagttaccaaatgagatcagtaaattgaaatcattgcgagttctgtcagtgatgcaaaatcgcctcgtcgacctcccagctggcctgtccgagatgcataagcttcagatcttcaagtgtgttggtaatcctctgcggaagccactgcgtgacattctggaggaaaccgagaacgagacgacaccatctgggatgaccgacaacgagaaagaagttgcagccacgaccaaactcaaaagatttcttatgaaaacgcgaccacagacgagtacacctgagccagaaataattacagatgcaaggtttgtctgcctcatggtcttgaggcggatataagctaacagtctgtgtcaacacagcgatggtactttcgaggttaaaccggtcccaacaccgataccttcaaagcggaatttgagtggtcggtttccagtaattcccagcactggcgatagctcagcagcctcatctcggtccccgtcgatatcacgggcaccgccaatcccattaaaatcccattatcgcatggcctctggacagcaaggcgctacttaccacatgccaggtctccaaagaccaggcgtagcgcctcattctgtgaacgagcgcaaccgaagcaatagcgagggcataattcaaggatcatctgttgctcgtagcaaaaggatgggactaatcactcgcaaaaataccgatttgggtacattggatgaaacgcgcccatatcgaaacagccatctacggggcctcagccatggatctgtgcttcgagcgcgtcagcctgcagcgccaatagccccgaatgacagtactaccccaagtcccaccagcccaagagagcgtcggcgtccgcgagacggttgggttaatcggatgtctagtctgcctgaacacaagggcgagcgtggatctgatgaaccgataatcaagagtgcaaaaggtattctgtttgccctcgtacaagtccattcccatatcgatacgttgatcaacattatcaagcatgatgacgccaggcgccacagcctcgagcttgtcttttacaatgcttccccatacgttgaccggcttaacgatgctcttgagaaagcatcaattactttgtccaatgacccagggtcaatcgcgtcagtcaccgaaactatcaaacgtgaatgcgagacgtgcatcgcctcctacattcacgtcggcacgcagctacgcaacaacgttgccaagattgtttccaacggcgatccgcgctatgtacggtcgctgatgctgacgatcttcggcagcctggtggagctacggaatgcctgcgctattctcgaagttccgctccagactcccaacaaaggtagctctgctacaaagcccttggttggcccgagcaacccacttccctcggtcccagaccgatcccaactctcgctggtcactccgacaagggaccaggcgccgcccacacgacggttgcgaagcgacacaacaattcgacaccctcaataccctatgactatgacttccaatcagactagcattagctctcctggtttctccacgtacgcacgcagtcgctcgagtagcagatcaaacgtgatgaacacatctatgccacactcgttggcaacccctcgctcaggcgaaaccttccctcctatgcctactcctggtgctccccgggccaacacactgactggactggacgaaaacgaagaggagcgaatattcgaaaagatcttccatcagctgactgctacataccatgccgcatacggggcacttccattggcccgtcggcaattcataaggtgtctagaagctgctcaacagtcacgcgattcagagggaatccaaatcctttggaacaacctcattcgtcgatgtcagttttgcctggaagtctcagatgccctgggacagcgtctctcgaccatgaaaatcaaagaaccaggcggcggactccgcaaccaacgcgagttctggcaactatgcaaatcattcatgcagtcgttcgtcgacctagtgaacgagatgcgcgagctgagaagtatgcagcttctacctgccgacgtcatcatcctccttcgcccagtccaaaaggcaagccgcgaagcaggccgtttgatcgaggtatccccttgggcctaccttgcagacccggaccgccatcctccgcctggtggcttgtacggccctccactacagacctcgcacctgcaacaccatcaaacatccgtttcaacgtccgccctcgccaacaacccctctttccaactcaatatgatgtcacccccgcagtcggtcaccgtccctgcgactccgctgagtgcggcgcttggccctgctgcgcaggccactgtcccgtccacgccagccagtgcatacagtgacaaattcttcgagggtgatgtcttccagcgtgctgactcgcttctctcgtcgaaccaggcgccgttcttccgtcgctgagcgactatgaaatatttttacgctctgtcatgattaccctatgctcatctttatctgcatcttatgattatgactatgagcatatatcgtgcatgccaacagtgttacctcggtgaatccttgtaacagaatctctgttttggcaacctggtcctcaatctgtattcggttttatccatgatttagcgggtggatctcttttaagaactgaaatccgagccatctatcgtgcatgtcattgactccagagacctttttttttttaccatcgaacacacatgcatataatgagtgccctttttgcttctttttccatgcattagcgggttagtctcctgggggagaaccgggccgttacataggtctcaaatgaaataacattgatccctgtttatatagagaagccctctgtacaggctatgccttcgtatacacctaaagagaacatctaaaagcacgtagtaagttctatcattccatcatgataaactcgagctttcgactctttggaacgtattcatatatctattacgtgtggtagagctaaacaatgaaaatatgtaagaatattatgaacgaaataaggtgtctagaacagcacggccagatcacccatgatctgtgaattgcgcttcacacaacgatttcgaatttaaggaggatgctgaagattgaagtctctctagagagccttgaacttccccaggactaagtgaaaagaacaaacaaggtcagccccaagtactaccatactagccataaaggcaattgttcaaaggcacagagtatacatacttgcagcatgagccaggtccgcctgggaatgtgccagaacatggagactgatatcctggagctcatagaagagatgatccttgttcgacgtgtagtaagacttgtcatgaatgcttgcaccctcgggcaccctacacgcaatcccagcagtcagtaccatattactctccatcaatcgcgagacacctcccgagagagaggggaaggtgatacgaggtgcctatacgtaccacgtgataaagactagcttgctccgctggccatcgccggcgggagagtcgtaggtgaagtctacgacagcataccgggcagtgtcgtccttgaaatgggagaggaagtcggggtagtccttgtatttgccggactcggcgacagtgatcttcttgtcgtgtgcggaggcttcatagatgacgtagttaaggttgtcggtgcctttgacctcgtcgaagacctcctcgcattcgggggcgatggttgcgaattttgtcatggtgggagatgtgtgggaaatgctaaggggaagaggggaaagtaaagagaaagacaagtcagggatgcccaagtgggctgatactttgtcatacaatggaagagatcaggtggtttaccccatattatgcggggaagtagatcatgacatactagtacctacgtggatgtgtgcatatgtactaataccaccaagatgcccacttatccgagtagtcctcgaatccatgctcgccaagtgacttctgaacttcccatcaccaatgctgttctttcacctgaatagcatgggtataaacacgagaagcattaccatggaaacaccttgatgaaccagaattccaaatacaataccattttgaacaaaaggggtcagtccttacagggctggatgtattatttctatatcaattccagaatgtccaggaactgaatgaccaaattaacatagaatgtcttggcacgaaactactgacgtgatggactgagacagcacgtgaatatctctaaaccttgcaaaagccaatctccccgcactcgataaatttccatttcacatcaactcattgagtcaatatggtacctcggccggacctcagagcgtcggaccaggtcgtcctcagagcacccagggatcgagcccttcgatttagacaagatgggacatttcacattacagtctttgaggatctacatttcgccgagggtatgtctcgataacccctaggggggggctcttgctaagcgcttgcagacgatgaaaaagacaggaagtccaaagaagtgatgtcatacatcctctcggaggaggacatcgacttcgtagtcataaacggcgacctagtgtccggtgaaagaacccaaaaggccgattcaagcaaatatatcgactcagtcgtttccccgctcgtcgaccggggttacagctgggcatcgacctacggcaatcatgatagtgaggttaatctcaacccgaaagatgacatgttcgaggccgagcgcaagtatcccaacagcttgacgcagagtagggtctccggcgacaaggccggaataacaaattattatctgccggtatttccacacggacaggcgaataccagcacgccggcgctgctactgtggttcttcgattcgaagggtggacattactataaaaagcaaggagagggcggacctgctgttaggagacctagttggatcgatgaatcagtagggaaacctcctggtcatgtcacatttttggaagaaatcactaactggctagaaggtcgttgactggttcacccaaaccaactccaaactgaaagaggagtatggaaaagtcatcccctcgctagcattctaccacatccccgctcacgcaatgctcgaacaccaacaaagaaggggcgtaaatccgcacctaactcccggagtgaatcgcgagcgcgtgaacccgcaagggaccggcgactggggctacgatggccaggacgtcaagttcatggatgcgctccttcacaccgaaggcctaatcgcaggattcagcggccacgatcatcagaatgattggtatgcacgtctaggcaataatcgtcacttaaatgactggaatgctaatcgaacattgcaggtgctttaaatgggatggctctcttgttgaccacgatctaaccggaaatggtatcaatatgtgctacggtcggcatacggggtatggcggctatggcgatctgctccgcggtggacggcagattttactccacgagggcaatctcggagatgacacggagacgtggattcgattggaggatgggtctgcccaagctcgtgtcacgttaaacacaacttatggccaggatccttaccttgctgttgctaatggtgctgggaagcccgattcctcgacgcagggctctttccttcctttgtcttggttgtgggttccgattatgatgctctcgcggtgcaggatgtagtgggctcttttggttatagacctcggagtgttatgttattcttgattagacttagggctatatagagatattctgcatgagatagattaggtattcaaggttcttccctcttcagcactttaagactctattctcgaggtctatctaaataatggattatatacaattctatgctgtgaatactgttatgactcctgccactccgtctttcttgtcatcttccaaccgtccatctatatccgggatataagtattgacagccaataacttaccatcacagtttacaggtagatgtagcagaaaggaccagagatggtactcatgatatctcgcatagcaacagtctcgccaccagcataaccaatatcaacaagcgtgtcaagggtagtgttaggcgaaggagggccgttcaagaaagtcccagtgcccgaaatagcattcatacgctttctggggttcaagttctgccagatccaccaagtgcgatcaatcataccatggtggagccagaaagcagggtcaccagggctaacaaagacatcacgagaaggatcaccgcccatggagtagtgaccaccaccgtggacgccgatgttgccgctgccagggacaccctgcatgttcatctggaagtcgtagatgttgtcgtggcgcaggatcaggtccacgatcgcagtgaaattagcgtagtcatggacaatcttggagctcagatcgcgcttcagacagcgggggttgtatgcgagcgggttggctgtgctttccgtttcacctcctggcagcatcagcgcgaccgggcccaggttgacagagtagtctttgaacgggccgctggtgacgcagccgcctcccgtgccggtgggcaggtggatgaccgggtagttacccaggcttagctggatgtcgccggtggattctgtgtaggcaccgttgccggacattgacgtgtcgctgccgtcgaagacctgggatttttccaggttggcggcgtcagcgccccagttccagtaactgtggttatgttagagattagggcctaagttatgcggaggattgttagacttacgggaagtcgccagtgtagccacactcgttgcgcatggcttcctcgaagttccagatgtagtaccggtgccatgccaggaaggttccggtgtagtggatgccggtggtctgattgatgtgagtagcgacgaagtcgtcgtaacgggaccgcgcaccaggggccttatcggagggagtgagcgagggcaactcctggaggcaaaggatggacttaatgtaggacttcttctgcttggtagagaaagccctccaatcgcgacgaatgcgcagcttgctcaatgaacagccaccgcgcttctcaatgtctgagtcgctcgagacactattcatgctgctgttgtatgccagcccagccaggtcgtcaagctgggactcagcgaccggcagggaggtggacgcagcggtggaagtggcagcgctcgcaacggcactctcagtggcagtgggcatagcccacgcctgtgcgaacaaagctcccagagtgaggatggaaacagcaaccatggtgagttgaatatttgatcctctgaaagaccagcaagttccacaccaagggttttaggagagatgttgatcaagaaggaatccggacatgattgtcgatttaagctaaatacatttgccaatcacccctatctgggacttttgactcgaactaaaagatagtcgtgccactatccaatttttttccctgcctaagagtctccataatcgcgagatccccttgtgctgggaccatttagggcaccgggccaggttccgctttctccaccgccgggacagacacttccatcttctcttcgggccactcacggaccgaccctttataatccggagatcaccaagatacaccaagagacacgaagatataggagaaaacaaaaggtactagtaaacctgaagcaacgatatcaccaaaaacagccacctcgtggcccccttgttcctcccgaggtcagcggcttggcaaattcagctaagcgacagacccaatcacatcaagatctcaaatcgaattcagtcaaaagccaatgtcggaagagacacccgctgccctagctgggtaaactccgatgaactgtaatccaccaatgcaaccttcctctatacccgaggctcatctcctttcaggagctcttcttaccgaagtaccaagtctgctcattggccaagtttcgaatgaccaactaccatcccagttcccgggtctgaggcgtattctagaacatattctattgggttaaagcattcttctcatgctagcgttggaccaagcttgaacgccgagaatggctttgtgtcttattccatgtgcaccatcgcttatgaacagccgaaatgggagtgtcgacccgagcgtgaaagagatggtagaaacaggtaattggtctacggtctcgagtataatagatgaaagccccatacgaactcaacccacttgccttccttgggctagaaagccacaattgttgtcggtcgagctgaatgtaatctaaaagttatgacccgatgcactatggattaaatctgctaatacttttgatggccctgcccggtttgccctccctagtataatccctgattttgattcttcctttcaatgtcgagccctccataacttttacgacggtcatgtcggacagtgctcatagaggagacgttagcctcccagatgttaaccaagggcctagaattataatagccacggctatcaccactgtcgccgcgttgatcaccgtcttggctaggttctacgtgcgcgtattcctcattcgtaatgttggatgggatgattatacaatggccctaacgatcttgctgtctgtctgtggcttcgccattatcgtccccgaggtgaaatatggtgccggtagacatacagtctacgtccaagacacggccgtaacggcaatgcatttgaattatgctacccagggtatttacatgtgggctattggcctggtgaagatatcaattggcttatttttgcttcgtttcgcaccccggaaaggatataaggtcttcatctgggtggtcattggtgtgtaaaggcttttatctcttttccctggcccactactgatgaacccggtttatggcagtcctcatgacactctacactgcaatctgcttcttggtgcgtaacttatccccacatacgatcgcggacagcagttaacagcttgattcattacagactcttatcttccagtgtcaggatatccgatcaaattgggatagctcggtgaaatcgaagtgctatactcccacacagcttctgactctgagctatacgaacactggtgagattgatacgtacgagtatacttaagcatatcctaactgaaatagcactgaatattctcaccgacctgatcttcgcggttctaccggtctttatgctacggtatgcttcatggacatcggcttttcagataagagactaatacaataatcgacagtcatcttcaagtcaatcgccgagtgaaagcctctctaatctgcatcttgggcctaggaatattgtgggtgacttcccatccaaccctatcgtaaaccatactaatcattctacttccttcgcagtgcctgcgcagccgccttcgtcaagctctcaatccttcccaactacggccgaaccggcgacttcctctgggattatacgaacctcacgatatgggtcgtgtaagttatctatactacaagcatccgaaggccaccttgcaaaccccatactaaccaacaacagcacggaatgcaacacaggcatcatggccggcaccctcccaaccctcaaaccactcttcaagagattcctcggcacatacggctcgcaatcaaaaacgagccgccagtaccccggcagcaagaaatataagatgcactcaatgtctcgatcaaggggtccaccgctacaatcccgacataaaagcggtaatctcagtatcgccgagtacgacgccgagccgaacattcagcgctcccagattgcttcaacggcaggctcggcgacgtacgctggaagtcgaggaagcaattccagtgaggagaggatattgcctgttcagggcgatggcatcgttcgtacgactgaggtcatcgtttcgcgtgagcagaatattccagagccgccgcccagtcctcccgttgtttcgaagttgagtaggatgggatcgctgagtgggttgcgtgtcaatgcggaggatagggtttaattttgtattttgggagttatatcttgggaagttatatgtatattgatacccaaagagtatatagccatataggctgtgtttgggcggcaataaaagggcctgttgcccatttgttacacatcctactcaaaaaagctgatatctcattttcgcactggactagggtttgcaaacgttctacattcccgctcacggtccgatgaaggggcttttcttctgtctcagacatgatgtccgagtaactcaagttcggtcacatagaaaaatagttcgtatttggatatcaaggccagaagccagtcattaagaaggtggaaataaagtaaaagaacggaaagagccaccaggaggagctacctcaatttcacatccacgcacagccagggacaacagcccccctgccagcgacagccttctccccaaacttctcaacataccacttccgtccccagcgcgcatggggcaacatattcgtgacagcattggcaacaaacaccacagcaggcaaaggcagcggcacagcgagcttaccagccgcccatgcagcaggcaccaaccaaggcgcaagacgcagcggaggagcgatccccacagaagacgccgagacagatgcagggagagcagagaatggcgcaaccgccgtaccagcgagagcaaaaccaacccactccagccattcgaagacgtagtgcggatacaagatgtatctgaagacaccacgggaaggcgggatgacgtagaccttgtggaacttgtttcggctgccttgtgcttcagctcccgccggaggtccatcatctgtctttttggcagcgcgtttttcggcttcttcgcgccgaagtcggaacaatgctgtctctgagtagatgttgccggccattccgatggcaaacaagattacgcccacggtggggaggagattgaccaccgcagagcgaggagatggactttcgctgctggctgtttggaagtttgggatagtcgggacggtatatccacgcaaccatccggccagacaggctgaattgaaccaattgaagaccatggcgaaggacatgatgacggcgtggattggggacatgctgggggcggagaagaaaggggagatgatggctcggttgaaatagtggatgcagtacagagctacaatgaggatgttggacttagggagatcagtgaatgagggtgcatatggcgatggagtgaccatgctatatatcaagttgatagggccgacaatctccatggcagaccaggcgatacgacctgggacgttgaagatggactgcgaggaggtcttgcctgctggatgccaggacaaaatccattgaattactgtcatctaaattcaccgagttagtgttgtagcatgttctagggcttcagggtcctgaccagggggaagtattggaagcagcatagaactgatgtgtagacagtcggacttggggaaaagagctctgcagtggagggcagagctccccaagaagtggaaatagtcgcacccataattgatagttgaagagaagaagaagatcgcggaggataaacaagaagcttaaaagcttgtgatgcggaaggcggtgggtcccggataaggagctacacagggttcaacttctcctgcttctttctcctcttcctccttttttacttatttttccttctatatctttttttctttttttaaaaaaagcaaatagtttaaggagtaccgatcaaggggacagcttttggcgagacaatgtgaaaattgtcagctttaaggagtgtactacttcgaatcacagtcgtgcaaacgaaacccttcctataactacaaagggtatgacagcaggcaaattgcacagagtgagcgaattagcgacaggactgggttcgtttgatttctactcgacagaaagtcagacatgtaaataacctgggggcataattccacataaacggagtgtagcattctgtcccgtgaacgctaatggaaatgcccctaaaagagcaagcttgcaaattagatcataaaaacttccttaagtcgatgtgtccatccgatcatgcaccatttccctccgtttgccagctaatttctctgttttgaacgcctcgatcttggccttaaggtcggtgtctaagaaaggtggttagtagtggatcaacaactggaaaaaggaaaattgctcaccagccaccacatcttcgatcttcaatggaacacggttaaacggatcgtgggggtcgctgaggagatgcgagcggattgtggcgcggtcgatggagatccgcgagctgggaaggatgactgggtcgtccatgagtgaatacataagaggatctagaagattagtagctgtcgaaaaacagtgttcacataaaggggacataccgaggaactcttcagggatctcgcccatatcttcctccgcttgctcatcggcctccttggcagcctggaccttcttctgcagctgactccagcgacggagctgctcgggggatttcagtgaccacttccggatgatatcggccgccttttcgaaattggctggcttgtatgatcggccatcacgggcaacagccaagatgaagttttccttgttgatcaagttaagatagacatccacaatctcactcagaagagcgcgggggttaaagccatattcctgcaggttatccactcggaggttcgagctcttgggtcccaccattgcgtcaaggttgtagtccagcatgtctgccaatcgttgcacaatttcaggcattgtgaacgagtcagcaagcgcatcggtgaatagcttgagcattgatacggtttggttagtcagttgcatgtagctcttcgcgctgcgctgcgctgatgaaagatgctcttcccgctgctggcgggttgcatcatccattgagttgccctgtgtattcagctctgtctgagtgttgtggatagtcttgaaagcaccgaaggattcgtcgagtacataagtcacatcgttcagtaggaggttgacgaattggacgaagaaatccaggttctgattggcttgaatggacaacttctcccggtacagagtgttgggccagatgcatttgatgatctcgaagatctcgtaacgaatgttaaacttgtcgtagaattgcgaatgcgttcccgtgaactctgcctcgatgtagaatttcatgaccgcatggaggagatgctcgttggcaaatggcattgagttgagcaggtcgaccaaaacaccgctggcgccaccagggcgtttccaggtgcctcggaacagaatggagatcagtccggctttcaggtagggatttttaatataggcggagctctccaggaatgtgatgcagagcattactaactcatctccctgggtggcggtaatgatctgtggcatgcaccacatgataaacttgaagttgctcacaacgtcctccaagaagtactctggtagacatttgaagacttcaggctgctgctctggaagaggaagggtaacctgttccttggggaagttctttcccgagacgagtctcagaagccacacggtaacatatcgcatgaatagcatggaacgagcttgccagtgctcgtcaaacaacacaccctgcagactgtacttgagagcaatacccaggtcgagcttgtccttgtacttcttcagggccgtatcgaaggtgcgcaattgctgcggattgttaagccagcgaactcgctcgagttcgaatttagtgattgtactctccatatgtcgcacatctttctcgagttgctccatctttgacgtcaatgattcactgccgtagtgatgagctgcgacagtcaggaaaaatatttcagtgataaagtttgatgttccttcaaccttcttggagtagaaagcgtcggaagcatgctgatcggcattgattttggtctcatcccgcatgtcaactcgagaatcgcggtggagataatctgcatcgactctgtcgatcttggtgaatgctgcatccatgaatggctcacagagctgatcgaggcaagttgtgatattgaacatgaagccgtcagacgatacttgctccggatcgacctgcatcgcccgtcgtttgtggttgatgttcatagcagtagcgaaccaatccaaaacacggtcccgagcctctttcgaggcccgaatgagatggttgataacgtcaagaagatcagagctaagcatctgctgtgtcattcgaagcgatcgctgggcattggaaatgtaagcctggtcccgggttttgggactagagaaataagacatggtgacgttagcttggagaggtgagaggcggaaccatggacccaaaagagtggttttctcgaattgagcagggtccttcgtgttgttaaaaatggacgattccgtgattgcagcagcgatggaaccgtggcgaacaagatttcgaagagcctgaacaaactggtcagacgtggtccaaggaaattggggcgcttagcttacaatagcgtatgacttgtagtcatcgttaacattcatagaagaaagctgcgcgctcaactgctcgacggcagatatgaaagcaggcttgacagagtcgtcttcgtcaaatcttctgacagcctcattgataaattcgaaatcgattcctctgtcatcctcagggtcgatgagaaggtacgaggccaacgatgattgcggggaccattcgctcctatagtcctgacagtcagtatctagtgccaatgcagtggcattccagaaaaacgaacccaaacatctctggcatcgtaatcgcaaagatacagtagctcatacatagacgccgcgcctcacagagaacctgatactttgggtcctcatctcccgtccgcctcaatcccttgtacagctttgtgatgcgcttccagcatggcagcagatagtcaaggggacgctgtctctcggcctttgatgcggcctctaggagggcttgatctagaaccgcgacctggatgcgcagatcctggccctcatcctgcagttcagtccgaagtccaggtaagtaagtgcggttgccatgaatatcacgctgcccttcttccttgagggtcactctgaacacggcgcttagtgtccggtcttcgaaagcctcgatgctttcaattttctgaggtggaggggtgctcggggctgagggagcggcggatcgtggtcggtctggtgtagccgcggccggtgtgatcttgatccgcttcccctctgactgctgcggggttggtggcgcgttgaaaagacggctcggtggctgagtggacagtggtgaatgtgatggagatgtgttagctgagctctgtgccgattcagagttgctgtctccggaggcttggaccgggtttgagagcttcgcaagtcgcttgttgcgaatcttttttttatcgaaaagatatgtcagtctccgtgtcactgcgggggcgggattgcttcgtaatttgagcacaacaagtaactgaccttgtctgcgtcagaaagtgtatccgacatattgactccaagtcagacgataagcggtttttgaaagtttggcaagaccgctaatccggtggatcgggtcggcagaatatcaatattgtcgtgatcgtgtgggaatcataaggaggcgtgaaagcggaataaggctgctcctaagcctcaaagcgggggaaagtatagaatctggagaaggtgaacgagatgtttgtgattccgtgatgatcgccgagattcctttctgttctgattcgagattcagcgccccggggccgtgatcaaatttgactaagcaaatctcattgtccatggtaggacgagatacaggatgggtacttcttatttcaaggtctcaccacataaaactatgtacctccaaagtcactatctgtatttacatgcatggtacactcatcttagtccttcctatgaatgtattttttcatacgttgaactatcagatgattgaatatcaagtcaagcaataacagatttatggctacaacctcaacaaacaatactgtgatgtgatatatctccatgcatctcaaccggaacgtgacatcagagatgaaaccaaatgtcgcagtttaaccaaacctcggaagaagacaaagccactgatatcttagatgcattcgaaactctaggaaaaataaaatatacagctaatgaactgaaactcccatagatgccaccttgtggatgggctaatgatattagagcacgttcttttgcaaaagagcccaacaaagaaacaacatgccatgaaaagatgcggcgtaagcctccaaagtccacagtgcatttagtatctccccttcatcttcagttgatccagacgtcgacagctcggcatctccattgcacgagccttcttcatcttctcaacatcagggaagagccacccctgcgcttcttgcagcctcctttcccgctcatgggcttcggcgtcacattcattccgcagtgtcctgacatattccacctccacgcgcgtgtctagctctcggaagtttcgggcactaaagttatccacatcgagggggttcacaaagtaattgagattaagtttcggggtcgagcggccaagtgtatgcggggagacgggggtatcaaagcgataggagggtccggatggggctgaggggccagagaagagagaggagaggagcggcaggataaatagaatgataagcggcaatagttggcgaaggaaactgcgggcatcgatttgagcttcctgctcggcggctgctgggcgaggtctgcggcggggcgcctggcctccaaactgatgcactcggaaacccgggccgcctcccatgttgaagacgaattgcggaccacctatagtagcacacgattagttcaggtcaagcgaataccagagggatgggtagtagtaccgaaaccaccaccgcccattccgccaaatccaccgttgaagaaccggttgaacatctcctcggctgagacctcctcgtcgaatctcgcaccaccacgggggaaaccaccaccgccgaacccactgaagggggatgcgccgctcgaagcactcggtccgggctggaacctgctatcaggatcgccgccgaatttgtcgtacttggacttcttctcctcatcggagaggatctggaaagcccgtgagaccactgccaccgcgggtaagaatcaatatgtcaagagctgggccagggttggtcattgctcactcttaaacgcctcatctgcaccttcatacccattcttatcgggatgcgtcaacaaactctgtttccggtacgccttcttaatctcgttgtccgttgccgagcgctcgactaacaaaatttcgtaaaatgccgtaggctgacattttcggatccgaagcacggcggctttctggtcatccgtgtacttgcgatcctggttgccctgctgatggtcgcgcgacgtcgcacccccgcgtttggcgtcagagccagatgccgaagccgagggcatagcaaccgtagtttatagggaaatacgataaatcctaaacggcacttatttgctggtgtaggagggaagagggggtttgagagaatccggagggcgtatgttgtagggtggcgtgggaccgcggataaaggagaaacaatcccgcacgagatatggttggtctggcagattaatcaaacgtgcgatgagatggccagagcaaaatattggcctgatcaagatgcagcgaaagcaaagtgacaaggtgtggctgattcggcggacataaattggggaaaaagcgtggtcttaggtgtctttgccaagcgccggaatgtctggacactgcgataacatcacttgccgaactgataaaccttccaacctttccaagtcggtgatattcaattgtgagtgctgctcagacccattcagttcaattaaagcacaccagtctcattgatatacctgcagcaacctcaattcttggctgccaaagctccaaacggtcttccgtattcatcaaataagtcctgcttcgaagctcaatacctcaacatggcggacgattcaactgtcgagaagaccaagcagacggtaatccagcgcttccgggcctggggtggtaagtggcctacgaatagcctggcgcaaccgtcaaggcaagcaatgtcgcaagtggtcactcactgatgtcgtttctcaacctagaaaactcattcccacccacgttgctcgcctccatgatcacagcccagcacatgcgccccttccagttcttcccgatgctcttcccacccgtgctgattttctccagctatgccaacctacagggcttcaagacggacactgccggcattagcgcagctttctccgggctgtatctgcttctcgcagcccgccgtcgacagccattcatgaagaagtttggtgttcggggcgtcgtgcgcggtgcgactatgggtttggctttggtcaacatggtcggtggtgggctggcgtacactctaggtaagagggaagaggaagaggatgcgtcatgattaaggtgccataactatgcgaagatcgcgttgctgtattggtgtcgcgagctgtcctgtacaatatgtgtatcaaaagtggtttagttgtgcgttttgggaaatagttgacctcaggtctcagtgtcagtgaatatgggtttatgaattattcatgcattatcattatacaagttggacataggctgtaggagtctccctagttattccgtctatctacactttggaatttccggaatacgggtgctccgatagcacgaaccgccgcacctcttcagggaccaagcagtcgaggtcctggggagccgattgcagcgcctcgcgggctctagttgaactcacgggctggtcagtaggggtacgaccctcgacaagctgaatccgctcggcccactccctacgtgcaccctcgtcatctcggtcccctctagcaagggctgccacataccccagctgctcctctctcccgccccactcatcgctcggccgcatagtcacacgcagcctgtgctttgacaagaaaggtctcagaggtttcaaggtatgttccggaggatagtacttggaattgaagatccggatcaaagtatcgtaacccgtaagatggacctgctccagaggcacagggtaagaatccgatgtctctatggcagcagctttatcgataaaatagggcttttttgtgacgccaatatcaatcaacgggagagtttcgacagcatgtgtgaatcccgaggcagcgaaggccggtgccgatgcgaggtgggcacggagatcccgagctaacagctccatcatcacgagccggtcttcgaaggaagctggcttggatggcttgtccgcattctgggtcgcgagaaggaggagaacgcgagggcggggctggggattttctagaagtgccgtggtgacaatgcggaggtgggcgcgggtggggggattgaaggacgaatctaagacatagagtgtttctgattctgcggagtgatcgggcgggatggttgttaagacctcgaagtctttggttgaggttagaaaccgcttcagcagtgaggcatactgggatcggagggcttggaaggacatgtcaattgttttaactccacgtcataggtgatctataaggttccaaggttcaaatgttgtgatgcgggatgcaggtgtcacgataagacgtcaccgtcaccgccttcgatatcgagatcggcatcccaagatttagatatttccagaagatggctccagcatgcgccatggttcacagaattgagatctcctcaattatgagcaattcctagcaatttgctaccagtccctagcaatttgcggagttgaggaggggtagtagagacaggggcgaaatctcaagtaggatgtttcatcttggaaagcttctccgtatcggcatctcaattctgtgcatgacagggatgatccctctccacaaacaaggctttctgaattctcgcttcggtgctacgggaaatgaaacactttgcaaacgaaagacccaaccttggaagtacaagggccgtgctggtagccctgcctagacctctttgatcaatttcatccgatacacccgtggacggcagatttgatcaatgtgccccaccaactccagtatggacggcatttagagtgaattgtgtacatcttcatctttaacagtatgggaaattagtagatagactaccccgtggagtccagaatgccatctttatttcaaagaccaatttatatcccgaaaaatggcgggaagcgggggaccctgggacacggcagcctgatttatgtgaaacccacggccattgtattgtgtatcccgtattattacagccgagtagagtcggggctgaacattaaagctttcaattccttttcccgtatgttccggacacctagccgtattgttctctacaatgatcgtctggattctcggactgtgtttccccattagcatctacattgtagacgggcctatagaagtggccccggatattgtcagactactctgatatatacgcgtgcatgtatgtccgtgccctaaaaagccgtttggggacatgctctccggagtacaaaaggtacacaacatattccatacaacataagttcaatgaccccctattaagcactctatcgaaaatgatatgtcgatagccggtgacgccaccaacgccacctcaccttaataggtcgcttaagaggctcataggcaacaatatcatatgagatttttatgtgagattaaaggtcacagccccggtgcccacgggctcgggataaatgccaatggtccaatgagatgtccgttcctgagacagtggagatgcatatttaccgtcgatccaccggtattaccgacatttaatggaatggattttaagatactcccgtactacggaggatttcatagtataatattaaattaaaatcgatatcgatgatttaatttaaggaaattaaggaaattaaggaaaatgagttaattacgtgggctctcttttcttctctcttctctcttctctacttcttcaagcttgttatctcttgacttcttttccttctctgtgagaagccatacgttccttccctgcgaattgatttcgcactttgctcagtcgctctttcctcaacacactcacttaaacaactcgctaaattcccaaggtcgctcgcgcattcttgctcttgacatctctctcatcccaccttgactttttcttggtatccaccgtcgttaccaataacttcatcatggttgtcttgaacaagttctccgttgccgttgtggccgctctggctgctgtgggccaggccactcacgagggtctccatgctcgtcgcgtcctggctcgctccgtcacccctggtgccgaagcttcgacctcgaccgtcctcgttgtgcccactgctgccgagccagctcctacggcttcttcttcttctgccgtgtctgctcctgaggaatcatccaccgtgcagtcttcttctgctccctcggtggcttccagctccattccctccgttgctccttccgttgctccttccgtcgttccttcctcttcggttgtttcgacccctgctgtgagctcctctgtgcctgctggctcttcttcgcctgtcgcttctagcagcaagcctgcggtcacccgcactcccatcagctcccgccctactggtcttcctaccaagtcctcttccggcgtgtctagcagtgtgtccgctcccgctggcactgacgtccctggcgatggctccgttactgtgacctacactgtgacctctggaacttccactagcgtcattaccactaccatctccaagactgccactcgggagcacaccgtcactgccgtatgtgctcttctgatatcttatgctttgtaactttgagctaactttgatatagacccagtctggctctgaagcctcggccaccgagtccgctggggacatcacccgcactcgcacttctactatcaacagcaccaagaccgagaccgtcactatcgttgaggttcccactccctccggtgaggccggcaatggttctggttctggttcttgcggcgctgttaccgttactgctaccgtcactgagactgtgactgctgtacgtgttgctaattcccttaactggcacatcaaaaattaacattcttttttttttctagggtgctacggagacccagacccccggcaacggcaacggcaacggcaacggcaacggcaacggcaatggcaatggcaatggcaatggcaacggtgagggcaacggtgagaccgtgtcggagtccactacccgcccatacaccagctccacccgcattcccatcacccgcactcctactccttcttccagcggtttcgccacccggactccttccgctagcgccagcatcaagcctatcccctcctccagcggccagccatcgcccagcagcacccccactggcaagccttccttggccaactggcgccgccacttcatctaaacaacacactgctaaggtgaggggaggctccacctccacatggcagcgagttgcgagcttgttaatgatctgagagaaagttccgatttccttctactcgcgcagaggcgtgctggtactgtacctatttttgacaagtttcggtacatacggtttcgatttcacttcttatttacgctccattttttgccatgtttcttcttttcgacttcttctattcttgcaatggtcttgtcatgccggattgttctgggcccaagctttccctgcctgcttgtttacgttttgcaggcgaacctcaattctagccgcggtcctcgatcttcaatactcctggcgtggcatttccttgcgctacatttttactctccaatgtgaaattgagccattcaccattggactcggaaccttttctttcgtatcgtcttgacgggtggtgacacgtctgctttgaggactggatcttgccccttttctgttgtgaagggaaaaaatccatcttgcgtgatctttacagatcttcattttgcgaatgatctttgcgttgttttttcgtcttcgtgtctttctttccgtgtcgaaagccgatgctgtgagcaatatcggtatccaaggttagaaaccctgaattgacttgaggcatttgcctgtttaccaaaaaaatatctctacttcatttgtaagatacgtaagaatgtagtggacgaggctctctatcccggagagcttatagtaaggcttggcccgtgacggacctgtcgatcagtgtcgatcttgggctgtgtcaggaacaacacatagggacgtggatatatagtatagtagagctttgagttgatatctcatgtcatttgtacattcgagagtattaatgtacatcagaataatatacagaattcgaatatccagcttcattcctagaaggcatgcatcctcccatcatcatcctgcctgcgccactcagaatgaatgttgatatctttatggtatcgaatccaacgcttcaaccccttccctcacaacccgctcccgcataatctgccattcaacccatgtcacaccctgcaacaaacaatccgccagatcatcgagtttccccggatcaacagcagccacctcgttcaccatatcagactgaggggatacacgcaacggaggaatagacccactcttcaaagcacgagaccccttccctttccccttcttcgacgtctgcgtctgaccctgccatttccgcatatacgcacccgcaacaccatgcagagcaggacactcggatttatccgcaagcactatcttattgtcggcagcaatacccagcttgtgcttcttcataccccctcccgtctccgggcaagaattggtaccccgcatcgcagcagaaagccaccgtccaacaagatcgattttagccttcttcacttctcgagcattgggtctcttctccttcacctttcccccgatttcggatttttccatgtctcctttccccgaatctgatattccagaaccaccttcaagccaatacctcactacccgtctcggctcaacgcctcgaacaaccaaatccgcaacttccccgcacctctcctgtcgaagcgtatgcagaacagcgtacagcatgccctccaacaagccaactcgcagcgtccattcaaggacggcactgcccccgcccgagcgaaagcgctgacgctctatgagcacatgcgtggggcggtatgcagctatgagtgatgagattagggtgtaggcatttgcagcatagaggtcaggcgagaaggagtctttttcttttgaggattgggcgaccttggcggacgggtctttttccgtttctattgggagattggattgggatgattccatggcatcaccagatcctgatattggttcgggtttgattatactggtattatccccgggtattaggttcaaactcgatatatccgaaacagcgagtcggtgccaggccgttaactctgggagtttggggttcgctgcgtctatcccgacacctggggtcccagagcggggcactcgcagatgcgcgaatgcgagattctgaacccccatatcgatactgagaatgctccatggttgcgcaggatttgatcttgacaagcctgccgactcggtctgggtcttggtcttggtcttagttgaccgagtttttgtcgacaccagccgcagatcgacccgtcgatcttggcttagcccggtggtggcactagcactggtactggggttggcattgggactactagtgataccctctgcaacaccatccgcggcagccgacaactgcaactgcaactgcgcctgtgaccgtgaatgcaacgtcaactccgctgcaatacgctcaataagaacacccttcgtaccagatgattggatgcccgttgcgcgcgcgatgcgctgcaattgtgctgatttcaaacatgcaagccaagggtgggttggggagtacagtgctgcagtgagacgcattggggggtttgtttgtgtttgcttgccaagggtggcattgggtgcggggtctggacttcctggtacaggcacaatcacgagcacggtaaataccggatttccgtgtctggctgtgcggaagacctgtaacggcaattttaggctggatgcatgggctttggaaggggatctcgggattcttgaaggtggattgctgatcggtgcacgggccattgacgttcgcggctaccgtggcactgggtcggattgagttcgttacttcttggtatttccagggttctgttgggtttagtatagagtagactgtcatttgttaggacctctactaatagttgatataacaaataaatattatatgcgccttctatttcccagacaaaatataacaccgagagccccttgtgtcagtaaaacggtgtgaataataaaactccccccaataagcagtaaatgcaaggcgctgaaaagcaagtcaaccgaaacattcgaaaacagcaggtaaaaaataataaaaataaccaacaccgaaaatccaaagagcaaagagcaaaagaccaaaacaagagcagattataccaatgctggctgtccaagctccaccattgcaatctcatctcggaggtacaacaacggagcccaaacacgccaatgcagcacgcctatatgagcaagacgcatcccgatacgctcgatatccgactgctgtggcgtcagcaccagcgaggaagtgctcactgatccagacgcacccgcagttccagtctgtggcgcagcaggacccaaagcggcagatagaggagcccgctgagactcacagatcgccaacggtgacagcggcaagaatctgcgggccgccgccagggtggtagcaagaatcttgctacgcatgctattttggaagaagatgaagagatcggtctcgttcgagagatgccattcgagcgcttcctcaatgggaataatgacctcgtccgcgacgacagggtcgagctgcagcgcggcacatgcaaagcgggcaatctccagtgcaatacagcgcatattttgcgtccagcgctttccgccgcggtggtcgggatcgtcgtcgttgttatctgggttccccgcgacgcggttctccaggtccatgccgtcttccattagggaccagacgcgtgaccggaaggtggagtaggtttcttctggcgtggagagataccgcttgtgtttgttgacgtaggactcgaagatgtaccaggcgatgtcgaggttgattaggttttgaactgttgagcggagttgccagaggcgctcggagtcaaagaggaaggtttcgggaaagtcaacgggcggactgaattggaggagttgggcggagatgccgcggaacagggcttcgaggggtttaagagtgtcttctgtttctggggttggagttgttttttgggcttccgcatttgcatcgtctcgacgggcttgttcgcgcacagataggtaccagtggcgggcggtttcgacctggaagccgccgcggttcatcttgccttggaagtattcttggaggaaggggactgtgtcttcgatgaggagaacgcggaatgctcggatctgatggttggcgacgtcctatcaagccacgaattagttcggaacgttgcaagaacagcaaggggtagatatgacataccaacttcatcgcctctaggattgaaaataatgttcgcaggccgttgacaatctcctgggggtcctgggagtgtgaacccttttcgatttgctcgaccatagaatctgcccactcatctcgcatcggagcgcaatgtgttttcaggagtttcgccagccatttggccagcgtgagcatgtcgagaacgcctttgcgtatttgctgcatcagtagtgggacttccaagttctgcatgatagttgggtgatcccgttccggaacaagggtcttgatgacgtcctgcaatgtctcgaacagggcgggcaaacggggatcgaaggtgcgtcgagtaccatcactcgactcgacttcctcggtggtggcatcggcagtcgcagcatggtaagagtagatactgatctctgcagccaaagagtcccaataatcggcggcttctttccgcttgcgttggcccttctctccgtctaggtcaggcttgaagtgcaggtcgcggtcgaagttggcgtccatacggaggttgatgttgctcatgatacagggcagatcaagctcgctgagggtcttctttgtaaccggtggagatcgccgagccttgcgcaataggcgcagatcccgggaccctagtcccaactcttggggtatactgatagcttccggtgacggtgagggctcccgaagccgagtgacagcagctggtgccggcggtgcagattgtcgagctccatgaggataggcgaagggttgttgacgacgacggagaggatgaatggaagatcggtcgtcacgattgtgagagtctcgcccctcattcttgtgatactctttagaacgaccacctccagcaccatatgcctctagagggccttcagcgccctcctcctgggtccgggcttcttttgtgccttgtagatccatcgctaatcacggtatatctgaacctcccctgctcagacagtcagataaaaggaagattttgggggtggcaatggcgagaccacgccatgcgcctaagcacagaacaaggcgaatacgcccctatgcaactcccactcacaaatttaataaccccctgtttgcctcaggcaggcagccaatccgcagtcaccgaaaagtgatgcaagtgagctgtcaattcctgtggagccgaggattgcttggatctgcgtcgatcgcctcgtggtttccgatcaggggggttgcagggtagggaggaactttggaaggtaaaaggatagcgggtggaaattagaatattgaaacacaccgaaataaaaaaaaaagaagtgtataagaatccgattaaaaagagaatataaattcagaacaaatagtgtatatgagatcccaaagcagaaaagggcatatactcttaagagagcaaacaagaccaaattcccgagagtaaaaagacacaatggacaaatcaaagaacgaaaagaaagaaaagaaagaaaaggagttggcaaagcgaccgggatgaactgatatagtgagtgttgtatcgcatctacaccggattcggctggacgcaaccagacattccctatgctgctacccgcgagcagcccccccccgactactgggtatatctcgacatggtcacatctttccatttccgattgaatcttgttatctgaatttgatgtcctaggaaaaaaaaagaaaagggggattagtcgcctcactttgaaccttgaaaccagcactggccacgtgagagtctccttttctcggggaaccactggatgcagtcgagttgcgcattaccaactactccgtactccgtacatagtcccagcttggcagagaagagtgcagagagtatggagtaagtaagtacgaagtatcgaggagagatgaagcagggcccctctcgtcgagatcggaatgtttttggttcatgtcttggcaacttgatgcctgattgcctaattatcttatgcctgataaacaaggccttaatattccttggcaaccctgtacttcgcctaccttcaccacttaactcccaccaattgatactcactttcatctcggatctgaataaaatcaccgtgattcaggaggcatctactgcttatagacggatatcagctccgtggatcttccaactccactggccatgtctttggccacaataaccccaccggccttattgacacccaaatctggctcaacaaatgcccgctcaatagctcaataacgccaccatgtctaaaaaggaagagataaaaaggaaacatgatttccacgtggaatctgatctgcatgatcatcctacatctttactacgcaatatcatctcgattacttgccgaagggaaaggatcatcatagctggacaaagcgcgagttccaatcatgaatatctccgcactgctatacttctttaatgtcctatgggcagcccctggctttgttctctcacgagcaattgcttcatacaatactgcacggttcgaagtacattccttgccgggcgtttcggaccttccacccagctgggctggtcgccttccggttccggggacggcagatggaaatgagatattcttttggctattccagtcagagcaaccggcatatgatgacaatttgatcagtaagtctgaataggacaggacatgcaaaggtggttgctaacagagttgtatagtttggttcaatggcggccctggttgctcatccttgataggtctaacgaccggcaatggacccattacgtttgatggcaattcaactgaattcattcgcaacccacactcgtggacaaagctgggcaatgtcctttacgttgatcagcccgtcggcactggctactccacagccagcttcccttacccggttaaggacaatgaccgggtaacgacggactttacgcagtggctgcgtggcttcttcgaatacttcccgcacctccagaaaaagcagatccacttaatgggggagtcatatgcaggcatctacataccctattttgcatcagagcttctcgagggtaaagattctctgcctctcgatgttcgttcgatgtcccttggtgatggatcttggggaaatggggcagccatggcggctgttgcaatgggcaaatatctcaggtcacagttgggcctccttcaaattcccgaagacgttctatctgtcttcgacgaggcggacgaaacctgcggcttcaacgacgtgctagcagaatcgaccatataccctcccgaggctaggattcatatccccggaaacccagagtacttcaacctccgacgtcgagatctagcaagtgccgtcaacgcggcatgcgatatctcacccacaaccccggaagaagtccgcacctcgatcttcaactcaacctgctacggcccctgcgccgtcttctcaacagcaagtgactacctaacagccgtctccgccaaccgcacaacccgtggctgcttcgacatctacgacatatcccacgactgcagcgccgtttcagagctcccactgatggcagagtacttcggccgtgcagatgtccagaccgccctgcatgttgataacagcggactttacagcgcctgcaattccacaatcttaaatacgctcctctcagtgccctcgcccgtgccaccggagtacttcatcctcccatctctggttaccaaccacaacatctcgctccatatctactcaggcgagtgggatatgttgatcaaccactttggcgcggaactctcgctgcagaatatgacgtggcgtggtgcgcagggcttcgcgcagaagccgagtaagccgttctttgctgataatgctgcgccgtcggcgaccaagcagcttctgctcgagcatacgcccgcgtctactacgctgtcgaccgccactcccactgctgctgctgtgggtacgtggactgaggagcgtggtgtgtcgtatcatctattccgtgaggctggccatagtgtctttgtgaacaaaccacgcgagatgttttcgtatgtgagggatgtggttgttgctccgagggctggttgattagggcggctttgggcgttggggctggcgaatattgggcgttggtaatcgagatcggtttagaacatgtacttttttttagaatttattcctattttcgaaattcaaggtcaagttagtatttgattaaatgggtcatgccggactcgtaacaataacggtaatggaaagctttcggacgatgtcgacaaaaatagttgcatcatataagaaaatcaccaaaagcaatgtgatctctgggttcaaacggagttttttcgtcatgcctttgtttcttcgaataaaatagaaatatcaaaccaattacttactgcagtatcacgctctcttccaagagatatacatccacatttggttcgttataccaattattttgagtgtttcggccgaagtacttgatttctacatgccatctaggaggaataccttgatagtatttatactcagttcagtaaacagcaacgatagtattacattcaatactctaatcgagttgtcctcgtagtatgccgtctcccgtctagaacgaccacaatgttactagatctagatctccattgtagacaagcacatggataatattacgatggtagaacatgtatgtatcaagagcaatttttagtcgaacttacgtcggactggtcaataggtattgatcggcggtcatcatgaaccagcatgagtcatgatgtatcacgatgaccttgggagggccctcaactatatgcttggtttatatgtcaataccccttcgacggaatggtgaaaagagtctgatgattctacttggttacttcatgcagttattgaaagcatcgaaaagtgcagttacctggctgcaacaagcattagggcttttagagtactggccaaaaagaaaggtctccaaagcgaaaaagaagctggatgaacgtcgtactgccacatataaacacacaagggcagagattgaggagacctggttagggttgtgggaaagggaaatagcgaggttcgattggctggtctccattaagcagagcaaaatcatgcatacccctatggcagagcagaggaaagccgtggatgcgtggatcgcgaatgggcggcaggagaccccaactgttgaccttcctgggacgagatgcgtcgctgtcgcctgattgactcagaggccgtgaccactgccagatagtttactcttctttcttttgatgcaattgaactatttcacctgttggttatagtaattttaaatctaattatattcgataaaggtatatgtgcgagtttcaaccagagagttgaacctgatgtgggaagcgaggcaacagcctatttaaatatgtgaaaatcgtgtgagaaaagcactacctaggtatagctgatccttgtagtgaccgaagttctctaatgagtgaaggcggtccgaaacatccctgtctcgctaatatgagtcatttttgtgccacgttcatgttattagagacaataccccaagcattgaatcgaatcgaatctcccttcactagttgtacggagtatactcggaattcaacatggctgatccactgaccagatatacccactcagccgcctttgatatagggaaattgccggtcagcgatatccatactctacattatgagcaatacggcagacaagatgggaagccaggtaagatacctttgataaagtagacaatttacccgattccgcgtactcgattatcattgaccacaccttgagaacgtctgaaaagcttgaatggcaaatataataacgtcactagtcctctacctccacggcggacccggcgggcatacctcatacagcaacacacagtacttcaacccagccatctaccgcgtggtgctgttcgaccaacgcggtgccgggaaatcaacccccgcagccgaactacgcgagaatacaagtcaacacctggtttcagatattgaagtgctacgcaagcacctccaaatcacgaaatggcatctcgtcttcggtggttcgtggggttcaaccctgtctttgctttatgcacaagcctacccggagatggttggttccctgatactgcgggggatattcactgtcaggaaatctgaactcgagttctcgcgtggatccattggcgcagcaaatatcttccctgaagcctacgaagcatttgtcaattatctccctgaaaaggatcgggacagactgaatgaagcgtactatgatctccttgtttcggaagattacgagacaagagttgcagcagcgagagaatggaataggtgggatttaagtattgggactttgagaccggagcctgaggctttcgctcaattggaagatgacgcgtgggtgcttgctcatgcgaggctcgaggcgcattacttcatgaacggaggcttcctggaagaagatcagattctcaagggggagaatttgaggcggattagccatattccgagtcagttacttcctactcttggacaaaatattgtgtcttgagctgggctaactcatcaattatagccactattatccagggccgctatgatattgtctgcccgccgcagacagcttgggatctgcacaagggcttgccggactcgcggttgttttggactcctgatgctggtcacagtcctagtgttagtacactatctgcctttgtttgacctggtttctgagacatggccatgctaacctcttcctaggaacctggaacgcgggccaaactgttcgaggtctgtgacgagtacgccgagcttgactttactcactgagagtggttggataattggctacatcccctgtttctgtccatacgacattccaaggttctcatcgcagttctcccacaatataagaactaatttaacatgctactcgtacattagaagagcaagcattctcactccaaatcacagaaaagctacaagaaacacgaaatattgtaaattgtaatattgacaactgattctacacgacaatagaaacagtaggtcaaattcgacaatgcaaatttgaccaagcaaggttgtagagcttgctgtgtgtggaaaaccacacaatgttgaaatggtaaagccagcaccaaccgaatatcacaacggaagtaggtcatgatgtcggccagcgccagaaataaatcgtcagtcatgttgaaactccaggcccgcttttggtatcctctagaaaacccgttgaaacccatatgttgaacttttggtatcatcgtcgtaactcatcaataaagaaaactcctaccgaggcgacaggttgattgtcgcctcctcattaaattaatggtaaattgaaagaatttactgcgcgtacttctggcggaagtacttggcagcgttgaccatctgtttgtgtttgatcagcattttgtacctcattttcaaggaaattgccacttcttaccgcggtgagagccgccttggtctcgggccagccacgagtcttgagtccactgtaaaaagaagcatattagcaccaacaaccaaaaaaaattcgaatttcgagtcaggatgacgaaccactagatgatatgttagtaaaaaagtatatagcaggagggtggggaatttacgcacatcagggttgcaccataattgctgaggagtcaagtatgccagcatctcctcgatgcggtccttgatctcctgctcggtgggaacacgaggggagtgaatatcgtaaacgccggggccaatgtggcgagggtaggcctcgtcgatgaagaccttgaggagcttagcatcggacttgctgttctcaatggacagaacatcggcatcgagagcggcaatggcgtggaagaagtcctggaactcagagtagcagaagtgggagtggatctgagtgccatcagtgacaccagcggtggagagcttgaaggagtcaacagcccacttgaggtaggcgacgcgagcgtcaccagcgcggaggggcagaccctcacggagagcgggctcgtcgacctggatcacagcgatgccagcggcctcgaggtcaacaacctcgtcgcggagggcgagagcaagctgctgagcctggacagattggtggacatcgtcacgggggaaagaccaccgcaggcaagtgataggaccagtgagcatgcccttcatgggcttgggggagatggaagcagcgaacttggactccttgacggtcataggggcgggacgagagatgtcaccgacaatgatagggggacgcacgcagcgggagccgtaggactgaacccaggcgtgggtggtgaaaacgtaaccagtgaggcgctcaccgaagtactgcaccatgtcgttacgctccggctcaccgtggacgaagacatcgagatcaagctcctcctggatcttgacaacatcctggatctccttctcgatgaacttctcgtactcttccggagtgatctcacccttggtgaacttgttacgctggatgcggatctccttggtctgggggaaggaaccaatggtggtggtggggaagagagggagcttgagggtcttggtctgctcagcgtaacgctcagggaaggcggacttgcggttgtgcatctcaggagtgaccgaggcctggcgggccttgacagcggggtcgttggtgcgggcggaggaggcacgggcctgaacagacttggcgttggcctcgagctgctcgcggacagcggcggggccttcggtgacagccttggcgatcacgacaacctcggcggccttctcaacagcgaaggagaaccagtcgcggacctcagcatcaagggccttctcgctggcgagagtgtgggggacgtgaaggagggagctggaggtggcaacaatgacacggtccttgccgagcttctgaatagcgttctcgaccttctcaatggcggccttgaagttggtcttccagatgttacggccgtcgacaataccggcggagaggacctgcttagggccgagagcggcgacgacagcgtcgagctgctcggggttgcggaccaggtcgatgtgaatagagtggaggctctgcaggtcggcgaggacattgatgttgtggacgatgtcaccgaagtaggtggcgagagtgatgcggggaccctgggcaccgagggcaccaatcttctcgtacgcaggcttgaaggcggccttggacttctcagcaaggtcgaagacgaggacgggctcgtcaatctggacatcctcggcaccagcggccttgagcttggacaggagctcgacgtagagaggaaggagcttgtcaagcagagagatcgggtcaacggtctggtcacggtcggccttaccgagagtcaagaaggagacgggaccaaggatgacggggcgggtggtgatgccagcggccttggcctcaaggaactcaacaacgggcttgggctcggcagcgagcttgaactcctggttgtcctggagagtgggcttcacgtagtggtagttagagtcgaaccacttgaccatttcctgttgattgagtcagcctactgaatctggacacgtatattgtaatcatttgcacataccagactgggaacatcaatgccctccttctggagaccacggcccatggcgaagtactcatcgagagggttgaggttgtacttggagtaacgctcggggatggttccgaaaagctggtggtggtcgaggacctgatcgtagaaggcgaagtcgttgctgggaatgacatcgacaccggcatccttctggatcttccagtgctccagacgaagacgcttaccctcagcgaggagctcatcgcgggagatcttgtcagcccagtaagcctcggtggccttcttgaggtcacggagtcttcccatgcgggggaaacccagaatagatctatccacgtagtcagcaactgtcccagcaactgctcataagagaatcgagaaaacatacgattgaaccattctgatggatgtgtgtgaaaagggggaaagaaggagggggcctcaaggatagaattttcacaaatccgattcctttgagagagtgagtgagagaaggaaagggaaaaggtctgggaaatgtcgaaagaaatatggagggggaggaaatacacactaatcccaatggaggattgatccacattcaagttggaggggcatcaatacggtatgatacatggtccagtacctccacgtacccctcttgtacctggaatccacagtttttgggcagaatatgtggaaagttgtgtaatttactgttattttcagtcctccgccagtatcaataccccatgatctccgtgatcggtcccccaatggatgatcacgccattgagacaccgataaggcctctgcagattgtttacgactattgccaattagtgctttttctttcctttttttttcagcgagggccttatgtatctatcgtatgtcgtatacacaaatctataatttttctcgattaatgagcggtcaagaccactagaagtacatcaaaatgcggaactctcagggagtacggggcaaccgctgtgtgacacgctgtcaattgactccgccacttaacctgcaggacaagctgaattgatactacatatgtacctagcgagcaatgagttgacagcttcatttcttccgtacgaagtaattttctagtcaattcctcatgattccctccattttccttctaaaaagataataatgactcagaacatcccctaacaaaccccggtgtcgggttccattcaagcaattgatcggcccacgtgatatcctgataggaaaaaattagttgagcatgaatggatgggtttttttttccgtaaagggaaaaacagaaagtcattgtgaagcgccaagccttcaaaagacagagaaaaatagaccattatgatctttcctcgatgttgttgcccttgatacattgaactccccgcaaaatgttcggaacagcgaacatcaggcccagaactccgatggagtttccgtgactaatgaagatgattgtgacctccgaaggcttggctatcgctctgtcttcgtccgaggctagggctcattcaacaatttggcctgctccttctaggccttgaattgcgttgggggaacccttgtgcttttctgtatcgccctggaggccgcccgcctgctatgcatcttctccgtttcccgccgcagggtcagcttactatgtactaagctttccgatccgtcggagacggtaaagtcggccggttcatctcgttcctcgttcccgcatggccattggttgcatgaaccaccttcctcgcaagtgattcgttcggcgtcaaaactacttgatttcgaagatcatcgtgttcaactcgaagacgagcttcctatatgaaactgcctacgttcgaggctgctctatggcatgcgttatctagcctcttttcctggccatccctaccgctaaataccatgcccccgcgcgcgtattcccttatgtgtgactgtgtgactgtcattatcatcgataagctgctcaacttttccatacctaccttccatcagaaaagcctgctactactggttgcgctgccagtcgctgtggctgtaggttattctctagtcactatctatgttattccggagtgacaatctagagcgacacagcaaaatattggataccccttcttccccacaataaacgaaaattgaaggcctttcggacccagccacgtctaggctctgtcttgtgtagtaagaggcacccaccatatgggcttttgcttcttgtgggtagcgggttagctgtccgggggtgtaaagtctgcctctagaatcatgaaaaacctcgcctggtaacaatattgctcctagaactctaggtaaaatcccccggaggcagccacaggttctcctggagcgagtggagtgattggttgattgattaatcaatccatagtctgtcttagccaccctactattggcagccatgcagcgttcaactataaatgcaggtgctcccatccttcgccttcaaaaattcgatccctccttctgctccaaacagttgcacccaactggtagctgtcctcttaactttcaatgctagaaataattaacccaccatgacgcagttatttcgacagcagtctggttatccgaaaagaaaatgccttcactcaagcccgcctaccgagcggctttcctcgagcggctttcctcgagcggcagaggctaacttcaatcttcgacctaattacgaccttatgaacaagcgaatccgaattttcctcttttgctgggcctcctttactattgccacgtcgggactcacaatctatcaaccgacttacaatttcaatcttagatttacgtgagttattccagcttgaaaacagttcatttgctaacaaaggcaaaagatgtacgggtgaaacccagctactaaacattccattggcggtcgtcgcattcggcatcttcgcgataccggccgtatgcaaccagccatcccacttggatccatgattgtgatcctggcattctacggcgtgctgtatgccttcccaaacaatagtggtgcgtatgccgcgacgactatcgccggaggtttctcgactgcgtagtaagtgtgacctagattgagcatttcacattacgtcaataactcacgctaaaacaatccaggtataccgtgatgtgaccctggcgagtccaaaccacagagggtgcaacgagatctgcctttgcaatcgcatttgcgaatagttatggcccgtttggagggatgtggggtctaaactgtttaattctcgttcgcacccacaatatgtgacttcctttggcattgcgatgggatttgttgcatggctatccttatgaaccgaaccttcttgggatttcacttggcgggtggttgttgatacgagaaagcagaagagaattcgactggcggcagccaaggagatccaggctgtgttgggtgatgttgatatacatgcagggaagaagaaataaaggtaaatatatagacttagtgtagtagaggatgaagaaaagggcgacagtgattctcttttcatacatactaccgaatgaacctgattggctagaggggttgaattgagtttgctagtccagaaatacctacctaggtaggtattaagcttgtattccaaccttggaatggcatccacggatccccggttgatttagcacatgtgtacctaggtacccaggtagatttcaacatgagagcaagcacatggtcttccagcccttcactgccaagtgacatcaactgtgggggtggatactgatgatcatttccgaaagcgttcaacttcccctcagcggagaacagcttgaagttcatttccgtttgaacacttctcacgttgacactccgccactattcaagcaaagcctacgcacaatggcatttgcacgcaggttagcgattatgcctggcggcctgggtaggaacacgagccacaaagccagacacaacgggacctaacttctccacaggcggccttggatcaagcattggcaaaaggttgagacaacaaggcgcccgtctcgccattctctatgcacctttcgaatctgcacgtcgcgatgagcttctcgaatccggatacggcgcgagcggcaacctagacgacatccacacctatgaatgcgacatcacctcaccagactccgtgcaggcagctttcaactctctagagaaacaaatgatcgacccaaattcgtcctctccatccgacagagctttcccaagtatcctgattaacacagctggatacgtatccctcagcgacatggagaccacacctcccgaagaaacactgaggcacctgaccgttaacctctacggccctatgctctgctctcaggcatttgctcgactctattttgctgcctccaaggctgccgagtcctcaccgagtcccccaccaccaggaagaatcgtcagcatttcatctcaggcggcacatgccgcactgcatcggcatggcgcgtattgtgcttcgaaggctgggctcttgggtctgacgcgcagtatggcatctgagtggggtggacggggtatcacagctaatactgtgtctccgactgtggcgtggacggatcttgggaggaaggcttggggggaggcgagtgtccgtgatgccttcttggcaaatataccgacgggaaagtttgcgcttccggaggaggttgctgattctgtgttgttcctttgtcaggtatgtttcctccacttggtgggctatgtctcttgttctgacttttgcaataggattcgagcggcatgatcaatggtgcggatattagagttgatggtggctttacagttagataacttcatctatagttggatatctccttcatgtcgatatccaaatctatatatccgaaatggttggggcaagaaacgcttttttattagtagatatcgacatttcgttctttattgtacatgaacacccttgggatcatccaatccacctcgccttgcaaccatgcgcccgacgtaacctttcctctgctccttctaggaagtaccctgctctggtctcagaacaaaacttccctagctgcattgattttcccgagatcccacctctacggcaccatcttgtccatccaaaccgaccagtcccccaaaaggccgggtggataatctgcgcatactcctagtactcaggataccatcctgcatattcccagtcaataacaccagtgacattgttctgctcgtctacgagaatattgcgcggcgcaatatctgcatgcgtggataccgagctctctgaatggggtggcatatccagtagttgattctcgcaccgacttcctccgtggtagagataccgctcgtatattctcgcacgcaaatctgagtcgctcaaaagtggtcgagctggcacttgtagatcttccagcatcgggtcctgggataaagagccatccgcggcacactggtaaggtgtctcaaactctgtaggcgagcgatcgttcaaatctttgagatgagattccacagttgaaggcagattggctcttagcctcgttgaccaggctatcccatttctgctctagagttattccgggaatgatagccatcccaataactccttcggatggacgataattgggcttaaaatactcatttgcagccgtctgcccttcattggaactaaaatcggtgaaaagcactttggagatcaagtacatgtctgcctatttgtttattgagtacagtgattgtctggcaggcttagtggatccagagaccatcgacatggtgctatcatttcgccgttcttgatatatcagtgtccctcgtgaagattccgtggttcataaggaacctcagttgaagatttggtcatattaaaagtgtttccatgtttccagtggtcacattcacttgaatggcaatggtgaggtggtgggaatccgagaaacccatcttcctgcggttgtcacaatcacctgagcacatggatttccatcacacgctgatatttgagacatataacctgaaacttgagcgttgatcaatacatatctactagcactgtttctccggtcctctctaatattactcggttccgactaacttgaatttagatatttgcggatttattctagtaagttctagactatcgatataattctcgttgtataatgaagggcagtacaccaaactggaaattagcctagaacatttctttgtatcgcagacctacgacggtagccgatatccgatctccataactgtagatattgatctggaggtgttgttggtgtttcagggcaaaatcagtgacagaggcagtggagggagagggagatcatatgtatgagtcaactacatctatacatctactcacaagggatatatatccacatcatcgccgcatgtacaccccatgaaaatcccacccctacacccacacctacatagtttcctacgtaaagtgtccactctcccaaatccagttcctagatattttcgcttcccatcaaaactcctaaagccatgctaacccgtgatatcgtaaagaagattgctttcggttccgccggcatggttgtctatgcgctgataccggggaaacactcggggagacccttgttgtgcttattggaggcatgctcgaggagactatagccgcggatatatgttagcaaggactcgatatgcagatagagcaacagaaacaaaaggattcgcaggggatagggatgtggaataacgtacgcaggcgccttggtggtctggaggaaagtctgtctgcagacctggcactggatgttcatggccttctcgttctagataagaatgtgggtcagtgactggggacaatatgaacgttgggaatgacgtttacgtacgctcttagtctgcgacttggcggtcttggtgtccttcgcgttgcgctcgcgcttcatgtttgccttagctccctatccagtattgttagttcactgcgtgttgatgggcctaaacaaagagctcagaatggcctggtgtcatctgtatgacttggggatgccttcttacattgcccatgtttgcgatattcgacttgacgtctgaaacgagagaaatgagttcgaaaaggggaatgcgataggatgtgggtgtgaggaagatctgtaattttttgtaaaaaaaattgtaagtcccggtcttaggccccacgtggggaacaaatgcttactaatcagatctatacggggccgtagcctggaccggtcgttggcaggcgaaggaaccaataaatttcaacttcatagtagaacagatggctgtgatgactgcgttagatatcttggcaatgtccatgattatcctctatgctcagcaatttggtactacaatacttatacgtctagttatttggaatgtataaaatatcaatgtcatttcatttattcgagtcgcaaacagcttggactcttggtactatccgctactaatacctacacatgtaggtagagaacctgatccgggcggcaatcattaccaatagtggaacggtatgcggtaaagcatcatggtgataaggaccgtgccaattagcaaccgtgcaaggaagagtgcgtagagctcttccatctgactggaagctgccccttcggatgggggcgcttttccgtctgtgctctgtcccgatccagctgtgccagcctggctgagaagtgtcttgcaacttccggaaggatccttggcagactgaactgatgctgcccccttgaaatcgcacgccgactgagccttcttctggccttcgtagtagcggtcaaagacatatgagagttgatccttgctggtacagatgctgtacgccccgtaccttcctgtggttgcgttctcggaaattccatcgcaggcggtcttgtcgcttccgcacactgtaccaaacaactcgccgtactgatcccccttcacagattgactgaccacgcacgagagactgtccaccatgcatgaacacaagtctttgttcggcgaaggtggtaggggactggactttgccagccacatgtcattgacggtgggacaggcgtgcggggaattggtgggggtgtaactaccgctgttaatgccgctaggggtcgcagtctgaattgccttcgagtaatggtcgaagtctgactgagtgctgacagatttgccgtcaacagagacgagcccatagtcgttggtactttcaaagtacatgtaaacgatgccaccactccagacatttgccatgtcgggaccgaagattgcagatatgtcgccaaacttgcgaggcctgatagtattgcatccatattcagagaagaatatagggatggggtaatccttgtactgctctgtgaggtttttgtaaccagagccctggaacgtgttgtctccacaccattcgtacatgttgtatccgaaaaagtcaattgaggtagactgatctccacagttgagatagtctgacagcgcattgcggaaatccggttggtcggtagttgcatagccaaagctcaaagactttctgtatcccttctgtttgacgtaggctttcatgtcgcgcaccgcggctttgacgaatgctgcaccaatggtctcattgacttcgttcacaacctcgttcccagcaaagaatccaatcacattgtcatattgatgcatcgcatcaatcacagcaacatatcgatcgtattgttcaacggtccaagtgggcgagttggatacaatcgacagccgaggggatgagagatcggcgataacataaattcctgcgtcggctaatttctgcatgcaagcatcgtggttcttggtcggatcgacagcgtagacgcggatgacgttggtccgcaattgctggaggtaggggatatcacgttcgcaacgagaaacatccgccaggggatcagtgtagtgagtgttgttagattgaccggtacctccggctcctccagcattgtagtcctctgaatgatagtcagtttcaagtcatgtaagagttggaagggtttcattgtctagtatccataccctggtaggcaatgccacggatgtaactagtcgcaaaattagtaactgaagcagtttcaaatagtttatcaactcacaattgcgtgccattgttggcataaaagaacttggaaccctgtggggtgacctcgttagttgcttgaatgccccgaacagtgaagaattacttgctttgatctcaatttgtgggacactggcgatggcaacagccaatagcaggaagattcctgctagaacagaatgaatttgcatcttaactgtattcaagtcagtcgtgatgattgctaggatagatatgagatgaataccaagctgttgagatgaaagccaggaggtttctatgtaacagctgcacgcgttgtttatggaagaaggaaaaggaaagtagaaggaggagagaaacaaatatccacgggtaccacgtgccacctggtcaggtccgactgcctacataaaaatacgaaagtgcccaggtgggaagcgacgagggggtatctgaccgcctcatattctgctcacttttcagtagcttggagagatatcggtaatttgaatggctgggagtatatatgcgtgtattagattgatttcaattatgaataacaccatcgaaacggtaggtaatcaacagaggatttgtacgtcctatcccgagcatagttctccacggtatattcccttcatcagtactagaatcggtgctggaaagtcccaaaccttcgactacaacaacagaataaggctcgcatctgctcgttctagtagcccagagtgtgtcttcgggtacttgcagtggataatctttcatagttggtctgtttatacctaggtacatgccttgcgtttgtatcgatatcctcctcttggcagagtcaagcctttttaatgtccaagtggagtatgtatgtcgcacgtacatacatacatgcggctccactagtcagtaaagcgatctgcacccgaggtcggcaagatccgacattgtcgctgacccacagctatttttatcgattcatctagggtagagttttgtcacgtgcaccttcggtcatcaaaggcaaaatccgacaaaatccgaactactgctgagcagacttgcctccattttacatctaatttataactgaagtgaactcatgtatcgattgttatagacacatcgtttctataattatctgtcaatgtatacgtgtcattattgctgttgtgatcgggcagcgtactaatcatccgcgggtctcttgaggttccaatcccattgtgtagtcagttcgaacgccacaggcgcttctattcctgtttgccttgaccacggggtgtgagttgtcgtgcagtgggcggctaaaaatccgaagcttggcaatgcaagggtgccaatacttatagtagtatggtcggtcttgtccattacacggtatacgggcgggaacctcaatgtagtctcccgggacattctgttgatggtggattgaaaatgataaacagaaaagtacatgctatactaaacaacataaaccgaaaattaaacgaaactcctgatggtagttacatagtatattccttgatctccgagtcccgaccatatcgctttggaattctagcgaaatatgacatcccaccaggggaagtgaaaaagaaggaaaacaagacaagcaaggcaacccgtcgcccttcgctcattaccgtgttcccaattaggccgaagcaggtgatggtgatgatgatgatgatgatgatgatccttgttgctgtcgctcttgttcttccttctgcttcttccgctcctttgcctgcacttgctcctttttccacaagccctcgtagtgatgcgtcacaagaggatctccttgatccgtagggtttttgttttgaagagcggcgaaagagactccaggcatgatcaaaacatcaccaaccagcttgggtcgtgtgatgtgtgcgtaatcgcgatcatcgacgggcctaccgagcaattgctcgagactctgcatgatcgcgatcgtcataatcttgggtcccgtcacgttgaccacgtccggaagcatttcccaggtgatcccttcgatgcccacggcattcgcccgagcaatgtctttcaattgattgatgacagtgtcaacgataacttgaagattgcgcgaattcttccgtccgacaaatacccagttgcagaactgggaagcaacttccgtacccggtcctcgccattcaaagtcgaattccaatccgacaatcatgtcgatgttctcatttcggtattccaggggtacccactcagagacttctttctcgcacgtggtgtctagaatctccccaaattccaccttcggcgagaacaaccaagtaacggaagagatcagcgcgtaggatcgcgattgacaaggcttcatatacttcgacgatatccggtcgggtcttaaaataatgagcgcggacaaatgcttcagtcgaccgatcggtgcgcggacaaatgcttcagtcgaccgatcggtcaacagttcttggcgcaaggaaggattcttgttcgtccagctgccggtccattcacgttgattttctgacaaattgtcagacttatgccagaccttgtctggaagtgtataaatgggtgcagcggaaggagtaggatgactgtcgctagctgaaggtttctccggaggtactgatattgataccgagggccccataccggttatccccgtctctggagactgcatgggactagagacaggggtggatgtttgtctccacgagtaaagataacaaatgagggcaaatgagattataaaggcgacggttaagcgcaaggagcgcgagtcctttaagttggttaacattggaacgatgaagagcctcaaagctgacacgaggggagaacgtgtggatacatgggaactcgaacaagaacatttgaaatcagcaaaaccctcagcagtcacctaaatttacattagcgtacggctgaacccacgggattttccgtaatttccgtcgcctgcgaaggccccttcgcacgtcgccccactaggtgattggagtggcgcagggatggatacatgatcatgcggatttggaggttcgtgcccttagtagcccattgccaaggcaatctaatgcaggagtcgagaagatcacgtcggctaacgggatacattgattgggccatgagccatcccaccaaattaggtcgcttagacgccccttattggtccggaggacgtagcttagcggagaaggtataacggtgaaatatcacactccctaccgacacctacttcgtgcctagtagcgtcgttcgtgtcaacttagtgggaaacagcataactagtatatatgatgcatattcgcatttacatggactacatcggggagctacaacatatgcagtcggttgtgaggggactttgtgcagattggctacaaactgtaacaataacaagatcacgtatggtcatggcgttatgggttcctagtgagttaccaatcaatgtcagcaaattcaaaccgatgaatgcaaatattgacttgggccctgttcctttccgtagtggcagcgctacgtgtgtcgctatgacaatatacccaacatcgtccttacgcaaaaccttcggcgtctaatatgttttgtgggtctcattggaaagcgaacacattatattgtgaattacaagcaacaacaactgggttaagtactgtgtccaatccaaggaacaggatctatagatcgaagatcccggctaataacaatcccaggctcctctccagcagctcctaccacagcagctcccacaatgctttctacggcagattgacaagccagtcaatcaccaacacctactgaggctttaacagcaagttccagccaagcttggattgcgggtcatcgcggttattgtagccctcatagtctggtggatctatcgacgaaagcaaaagcagcccccgttatcacaagaatagctctttatgagccacggtccgctgcagccatcacacccacccccgggatatccactacaacagcccatgggttatcccccacaacagccgactggttacccaccacaacagtccacgggatatccactggaaacatacaaacaaatgcatgaactgcccagtgtccggactccgcgtgtatatgagctaggctcgaatggctacaggtaggagacctgcgatggctgaagtggcgaggtatctgatgattacgaactccaccgtgatgctgaaatggccttgagattccattatatgttgatgacttgaatgtagtctcacgatgtgtcgagtggctggtgtacataccaacatgggaaagaagcgactttatacatattcaaggaccgagctttgaagctaataccacggcatctttatcggaggtttttttacatatttggttcacttcctgcccgcaaatacatttttctcttttctgttccatgtcacaaaagacttagaaacatcactatacataatgcaccacaagtatcatgtccgctcgcatgtattctccgcgtcaacatccacacagtgcgcagcaaacttactcgacttcctcagacgttccccatatatcctcaatacaggcgacaggaagcaaaacccagtagccagactagccaggacacacatggctttattcggacccagcccactaaacattcgcccagaaaacaacggaaatgaagccgccaacatacagcgcacaagacccagcgccgcaaatccactagccgagtacgaccgatagctgtccgacatatatccaaccagaacgataccaaactcgttgatcgcaaacccggtcaggaacagcggcaccacagacgcagaataatgcacatgcacagcgggagggatcgtccatgcaaaccaccacaacgcaatcattagcaccggtgcagcgataatgtacccggttagtttgtgctcggggataacgcgttcgccacgctggcgccggcgtgctgttttgcggtactccaggaagcgggtaccgaagtttggaaggaacccgaagccgagggccaggaaggggagactagcttgagtggctgtgaggccgaatgattgataaactccgggcaggatatccgtgaacaggtagatgagtccagtggagatgccgcacacgattgagactgctgcgacgatgggctctgtgaagaggagctggactggtcggaaggcgaactggcgcgcgaaagactggaggtctagaaccttgtctgggttcaatgcttggagagaatggtcgccagtaatgcgacgcaggtgtcgaacctcctgtgtcaggaggacagtcgggcgagattcacggatcgcgagtagcaatatggttaggattccggtgactatggcggccacatagaaaacccatttcctatagcgatctgttagttctttggtctttatctgtgtacagactgtcttcgagttggaacggtacttaccacccccaaaccgcagtgatgtatgcactcatcaccggccccactgcaatacccaaattcgccatggccatgtacggcagcgtaagccatatcatctccttagtgtcgaacatatcttgcatactgccattgatgacagcgctcgggaccgcggacaaaaagcctgtgatgaggcgccctatggcgcctgcagcaggtaactccgctgccgaaatcaacacgcagaatatactgtacaatgcagtgctgcccacatacagtttctttcgaccatagcattccgagtaaggaggcaatactatgctgccaatgccttgagcgagaagatatctttgtcccatctggtaagcatttcccgtaccatattcataccgacagagaaatacactcacgtcgagatgtatataaacacagacagggtctcgccaattccaaagtggtgctgtgcatttctggcagctgtggcctgcttacaagttagcatttaagataaatgcaatgtagatgcgatgccatatacccctgatgtgctcactgcagtcctaattcgcaagaatggttagactcatctatcatcaatacctgaacggggaaacccacgtataaaactccaagaagatgataatgctagcatcatacgcttttctcgaactgctccaattccgtggatgacgcgggttcatggcatcccaaccgacgagattcttctgatctccagtgcgcttcaaaccttggattttgagggcttggtttacctctagccgtggtttgggagccgggatgatcatgatggttactgagccaaggattgaggttaagcttaaatggaccgggacaggaaaggaaatttataggattgagcccaggcattcttcaattgagtttctctatgagcacataggtttcggaagtcctagaaacattagctgaacagcagggaaaacttgaatgattctggtagatcttatagatacatgcaagggatggtaataagaataagggtgctgaagtctttgacccaccgcgaggacgtaagctcataacccacataagagtaatagctatgttgatcttaccatcatcatataatctcccttgttgatcatatacattctctacgcttaagaatgccaattagccaccggggtttggcttgtcctttgcaggtggtttacgtgcgaccggacatttgcagaggggcatattagttatgcaattgaaggatctgcttatgaccatggctaagctttgtatgcaggatcattaagaccacgggtggctgtatacttacggcgatccatatttattgtttcaagtatacatatgcctggatactttcacttcatataattgtcgttcaaagtccaataaaaccagtgtcatattagtgttcatgatatatatcctaactatatcgtggttgacgttgacttctctagcgttgcacaatcgggacatttttaatgggcttaaccagcaagagcttgaactaataaatcaaataccctatcgaacagtgttttctttccccttttaggtgtttagtttcttttctatccctgttttcactagattcatcatcagacgatggtggacctaggacctaggaaatactagggattgcactgtttcagaagaggttaatcatcaacacgctcttttcaacccgaggctcctatattaagccaccagtataccactatcacaacaggtggcataaaatccaaatctcggcctcttgcttcaaggacttaaccgccgcctattacttgctgtattgagtacattcaagattctaccttagagcctttgtacggttaagatcaacagctgaatcaacgatgttggcatggtggtatataatcccagagtaccaagccccttctaatcaatgctttcacacttaaactgctctaacatacattcattggcagaaaacaaatactaacacaaaatattagaagagaacacgttttaggcaccctggatacaaattctatagattttcctcgaaatacccttactctagattccaattatttgcacacgtggagagagtgcgagatctacgggcgacgaagtatgccacgcaggaccttggtaatattggtcaatattgttaccgttttccctcctttcttcaattcacaaaatattctatactacaaagactgataacctggtttgatctataagtatttaggatttaacttagatggcggtatccccccgggacccggggctctggcaccccggcactcgacctcaacaatgaaatcggttgaatagtacgtagtcgatcgtgttcagctactagccaatctataggacaacgtccccgtgacacacctcatcgcccgttgggatatattactgggaccaccaggtacaagctgcaggtcaattcaatttggtcactggtgaaccaaagacgctggtgtgcattaaaaagaatttacactggtatttaagtatggggtcgcatcgtcaactcgactttgaatcgcttcgactctatcatatacgaaatctgttcccagatccctgacagtcttgttatatcccacacgcaagtttgctacacttaccgctgaatacgacttgcaatatgccgactgtaaacttactggaataccttgactcgcgaacccaggtggatattgacacatacagtgctgaaggttgtgggtcttttgacttgtgttaggctgaaaactaatgaaggtctcacatcagcttccaaagaaattggaccctttcaagatgcaacaggaaatcaagtattagaatatacctggaaggcctgttcgtctgtgctaattcgcactacagcttgaggtgcaagcggagattgtcaagcccagcagaagtgccgtgctgaaaagatcactagcgttggcagccacgatccatccacaatttgccaatcttaaccttgaggagcttgcggtggaggtggtggtaagtgtccagaaaatggagtgatgcggatatagaaagttgaccggtctaggcaattgaactagccctcgaagtgatccaaaatgtttacgggaatgtccatgttatgataaatccaagctatgcctacaatactcaggcgatagttgcaaatgcccaacgtaaaatgtaccccacaagtctacatcaagaagagagatgttaatttacgtaccccaggatcgcatcttatctgccaaatcgttgaccccgactttgacacatctcgcctggtcaccaagataccaacgacatgggagggaatgcaagctgcacgccagctcaagcaaagtggaataaagactttagccacgacgctcttctcaatggaacaggcggtccttgcgggcgaagccggctgtatatcgatttcaccgtttgtgcatgaactcaaaaccgagacttacaaggggtgagtgagagatatcggcgggtgttgggtgtatctctaattttttggcagatacaaggacagcaacccaatccttagtgtttgtgtgcaagcacaacagttctatcgccagaactctctgcccacacgggtaaaagcctgtgtgacactgagcatcgatgagctgattatgctcgccggggtcgacgcactgactatagcaccagcggttctgaaagaacttgcagctatagagaggccgcaagaggagttggatagtatgtccttgtttgcgataaacgccaaggccaccgaggctgtcagctatccttcgtatatcgattcggagagtcaataccgggttgaattcgctgccagtgagggtggaaaggcgcagtttaagacagcgcaggtaagaatacatttttagcttgtatcttttgcccaataaagactgactaatttctaatgcaggcaattgctctgttttgtgatgctcaaaccgcggtggagttgtacgtcaagtctcaattggaggactattcgtacacaccaatcactttataaagcaccatttgggcggtactgagagtgtaattcaaattatagagactcggtctgtcagtcttaagttgttgcttgttcgtttaattattttgcttcttttgcttcactgcggcatatgccgtcgtgcgaaacctcagagcatctagccaagaactcgagcttgacggattgaccttactgtgattatgactcagtgattgggcatgcttagaacaagatataagaattatactatattgtctaggactgatcatgactttcggacataaataaacgcacaaactatcattggcccacttcttgagataccttagatatgctcccatcttccctagccagtattattgaatgattagcgatccatagcaatgaagctcttgagggcctttttatagtcgtaacagcagtctataactagcgcaaggcttgtgttacagcgggttcgtaggtgcggcccgcgtttgacccacttcggacgctagcatgcattgggaaatgatttccacgaaggtaggtgcatgtatactgggtgaagagaacatgaaatttcaacatacatgtgtacctgggtatgtaatggctcgctctaatcaatactccaggtatctatctggatggtatcttcctgtctctatgagtattttcaaagttgaatgttcgtaaacataaattaccaggatccgaatgtcaataaacagcaggagcgacctcggggtgttccgaaatggaaggtgctttccccaaaatgcccttaaggagaggtttacgaacgcgtaaagttcatcttgtaaacatcccatgtccaaatgttcttatttgcatgtccgcgtctccgaaggggacatcgagctggatctccaggtggtttcacacaatcctaccaacatggtcaaatgcagaatgtggatggtgcgagggagcaagcccaaggtaaggcccaacccaatatttgatgtcaaggtcacctctggctaacttgggctaccgcaggcccctcaccaggaccaactacaactcctgttcgagatctgaggcggagatctacgagtatttcacgtcggctccggcatcgattctcgagagaatccaggcagtccggcgaacaccgccccatttttcccttcttgatcaagccaaagccaaatactcccaaaggaactacggggctatcaatggttggggacatgggaagcagtctaatgagcgaacgagggtacgacagtgatgcccagtatattgggagtcctcagcatgccgatcatttgagagcgtcacccggaagcccggcggttcgcagaatggggttgcatgatctaatagagcacagtcgtgagcggaatgacttggagatgtgggcgggttccgcaagccatgatcaacccgactccccgggaactccctttgggatgcactatatacccacaccaacaggaagtttgagggggcactcagcccatcccaactctgcaaccgagggcacaggtagccagtccgtgccttcattcaacaatgggcggtcgggcgatcaagacacgttcacgaaagctctcccaagtctccctcccagtcaagaagaatcagctccaccaagcctagatcgcctccgatctcgagaaggctttataggcagcagccgtgagaaccttcaaaatcttgtgcctaactggactcaatacgtgggatcaaatcccaacgatcgtcgcgcagcatcttcagcgtcgctagccagggaagatcggggcattatggtttcgaaaacacgacaaccaacaagctctcccaggacacactctgagacccgagtaccgcatctcggtgatctagacctttcccacagactcgcagggacaagcatggggtctgggccgccatcaactaacccatccatgttggaactgccacgtgcgaatagatatgggccacaaatgacatcacaagagaactttcaatctcatgagagatctagaacgtcagaaaatgtgggatcggagtcccagaagcaacctacgtctcatcaacgagacgcgtcctccttctattcgcgtcaaagcagtagcccttcacatggggcgtctgccgttcaatcactgagaatccacgctgcgaatgaaatggatagtctaccgaacatccatgcacgaatggcagctgagactggttcgatccaaagtgaacgggaaccaggtgccgaggttgtgaaaagcaaatttgttgagcaacttgatgcggcgaattgggggacaccccatgttcaagggacttccaatggcgccagcagtacctttccacatcgcagagtcagtcctggctggatgaccggggggcgacgaatgggctacgggtatagcttggtggaacatgctgacgatcacccaccaacaattggagggaacagcagtccatttccaaacggggattgtaacacgagccctaccaataccaacggggaacctattttgacaacaacgatgtgggccaaaatgaagagccaaccagtccgaggtaatcgtcacgcaccgctggtggtggatttggctggtgaaagaatgcctgcagaggaagccagccatggaagttcaattcgcccgcagcacattgagtcgcccacttctgcaaaatcaccgacttctgcaaaatcaccaacttctgcaaagacgcctacttctgcagccagcttctatatcgaagacgtggatgaaacgttcttaagtcgatgggcgaaggccagccgttccacacgtaaacaaccacaaccaaacaagtaccacgattcagcccatgggcgcactgtctcttctctgaatgattcaccacttggtgaacgccgctcctcggtggatcagacaaactatccgccctccgtgtacttcgatccgtcgaacgacaggagtgcagacagattgaatagagtgccttcccgctcacgtagtggacgttggttactaaagttctcgagaaacagggaaagcaagaaacgctcgaacctccctgcaaaagcagcatctcaggaagaaccacttcaggagtggccagtacagtacgaagagcgtccgtcgagtgacctaggccgagcagattctaccagaagcgatgcagcagaagagctcgcaagtgcgtatcaggactgcattgggatgcctggggccttttatggaagccggtgggcgagccgaacaagtctggtggtggaagcagagtgacgaagacgcacagcaacaatcatcgcagtagtaacaagggtacattggttgaacaagcacacgaatactgttatcggggtctctggggccaattctgctgttattattatcggcggggatggagttggtttaattatgagtatgcttctcagtcaggtgtcattaatcgtacagaatatgggtaattgatccctaatacatcttacacttcgcagtgcagttcatcaccagtaaagaagcaaatcatctatctcctctgccgcttgttgctcttgtcgcttgcgccactaagcacactagcggaccgcttgtggttaccatccccttgctgagcaccagccccctgtgtgttctgtggggcagtagaatgacccaaaacgccggcatcgccatcttcagtctctttcttcacatggggatgttcggggtcagcacttggccccgtgataccagcagcttctcgcagtttgcgttcgcgctccattttcgcggcttcgagtacacggatctcactttcaactttttcggacaccttgcgggcgtcgagaagcatattgacagactgaatgagtttctcgaaatctttgcatacacgctcagtaggcatgaacaggcgcacaggaatctcaagctcggatagagcattggccagtttctgggtttgcacgttggacttggcctgcgtaagtcgctgcgcacggtcgctgcggaattgcacgcctgcggagacacgctcgtgatgctggacgccgtactttgcttcctccgctggggtgagcgtgcgtaccatttgattggtttcctttgatgcaatagctcccttcttgtttgcgccctgtgacacgggggtctcggctcggcctaggccacctgcggtagttggagtctgaccggcaggacttgggattgcaccgtccccgaggatggagcggcgtttcttgctcttgtcggcttgcagtagagtctgcaagagctgggaaagacccgcgctggactgatacattgtggtgttgccgacgctgatgggaacctcgaggcgagagtagagctctcggcgttcggtgatgaagttctgctcgttgcttgtaatgcgcttcaattcttcgagtagcattgcctcctcgcggacctcatcggctgtccggttgagctggagagcggccagttctttacggtcgcgctctcggtcggggtcaaacttgagcatcttttcgtgtagatcgaactcggcctcagacatttctgagggtgggtgttctagtgagagcattgttgcagcaatgtaatagtatcgcgctttcatctgctccattgtccgatggtgtttcgcaggcacaagggcattcgcatccggctgtgtgtccattcgtggttggtagtcataacgatctgcgatcagcacccagcgaatgtcgtattccgtgacgagtcccaccagataatctgtttcctcgcgcgaccagtcatcactttgaagatgtcgattatactcgtcatctgtgtaccgacggggcaagcgcggtttgacgttgtacttggcgaaggcatattcctgctctggcagtttcggtacgtcctctttctcttcttgcttgggctgatccacttccatctgggattctgagggtgcaggtgcaggtgcgggaacaggtggtcgcgccgactcgtgttttctctgccagtggttcaaaaccaggccatccgaacgggcattgttcgtgaacggtgtcatgctcctacatagggtccaatatcagtatgcattcgggatctccaaatagccgcatcttgaacataccaaggtcgaacgcgcagcttgttcatccattttggacggcccttgtacttgttctcgttaatggcgattggtggcgccctttcgcccagtagcgcgtacaattcacgggtaataccctctgcaacggaaaactgtcagtaatctatgtcattcataatagagcgcattacacctacctggtcgcttttcgaccaccttctgcttcttgtgtggtctgggttgcccttctgcgggcaaatccagcatgtcgcgcacatcggccgcggccatattggcggttcgatcgggggagtgatctgtctagacacgccacgaagggggatttcttcggttttcgacgattaaagatttattaaacggccacagagagataaaagcagaatttgtttgatgaaataaagactagtgaatgtcgaaattgaagatcacatcgacagaggcttcccgctggaaagggaggcattccagagatggtaggcggtgaggtgccacggtccctgatgttgacaccttcacgaagagtagaacttggctgtacgactatccaattgcccatttcctcatcatggctttcactgggacatcctcgtcatggctggcgtcagcattgaccctcctctccttcttttctctcctcctcccaacgaatgccctgtacttctacatggagggccggcaaacaaagtgcttcttcgaggacctacctaaggatactctagtggccggtatgcgccagtctatagagccttcgcgaaggacatttaaactaatatattttgttaaaccataaataggccgtttcgagacggaagtcatcaacccccagagcggcagctacctgatcgaccataacttgaagatgctcatcaccgtcgacgagacctttgacaatgaccaccgcgtcgtgtccaagcggaacagccactctggtcgttttcacttctccgccgcggatgctggccagcacaaaatctgcttcacacctgagacggatgcctcgtcgggctggttgtccaactccccaggcgccgtcaaggtcaccgtcgaccttgccattggtgagaccagcaaaatcgagactgaggacaaggacaaaatcaaggatattgtgcagcgggtcaaggatctgaacagccggttgcaggatattcgtcgtgagcaggtgtaccagcgggtaaggattacccaatatccaatctatagctaatgtctctgtgcatggttgaagcggacatactaacgttttgtcttttttttttcttcaggaacgagagtctgagttccgtgaccagtctgagaccacaaactcgcgtgtcgtgcgctggactctaatccagctcgccgttttgtccgccgcatgcgcctggcagctctcccacctgcggtcattcttcatcaagcagaagttgacttagataccgcgttgtcttattccctatagcatttctcgtttcttatgccttgcatcttccttccactgctgtggtcacgcacgccggtttacgtgaatattgacgtttggtgcttacgtgcgttggtacactgtttctctggggaacagtgggtctttaaattttgatcggaggcatttcggcttccggaggtccctttgttaactcgttagccagtgtttcgacaaaaaagggtgcggagtgcttgagcatggtcagatgtcgatcttgataatggatgtaatgatatcttttcttctattctcttgtgtcttgtaggtcattgaaaccgaaatttgcccacgccaactacagtcactggggtcaacatcgtatattgcctacctaacccagagggcgatactctgaaaacgctggagagccatctaccctattggaagacttctatataccgtccttcttggctagcacttcaaccgggagcagaggctgctcccacctagtcggcttgtgatcaagtacactctctgctgcatgaaatagaatcctgaccctgctatgtaattatggtgaagacagcatctgtctcatagcttaaagttacaagagaatgtcgcttatcaccaatgattccctcatgcatctctgggaggatccccaggtacaatcttccagcgaactggaatctgtgaggctctggttccagttgtggattaggcacctctcctcggagaaggtctgggttgtgtcccaagagatacctcctgagggcagtggccgtcagctcgtggatattaccatcgaatatctgagtgaaggcaaggccttaaagtacttgctttccataaagtaaagccaccgaacacggggcctcaagatgttgaagaggtcgagggaaggcacttgatgcttgtatgaggtatcttggagagcaccccgccttgtaatatgtttatgcgtttatatcattcggaacgaaggttagaggagggcgatgtgctcgagatgaccatcatctattccctctattcggctccaaggcgttggctgaatgtactcagtatgtcgaggtacactcctcagaggctcagctgatcaaacaagctgtccaaatgatgagagctttaccgccaactctctgaatagagcttcggaagtgcactatgttatttgttccaagtggtataattcaatccattggatattattttctgcctgacatttatcgctgtgacaggagatcaatcatataattcctcacgtatggttattatatcatcaacagtcaggacgattcttcattttcggtgtcaactccgcaggtcctcggattttagatataaaatgtgttaactttgcaagatattccatatataacatgtaatgatcaaagcttctggattgaagtactggtgtaggttcagttataggctgctcagagtggaaagatgatcacggctaggagtcgagtctcagaatgtaaaatgctcattaaatgactctatatgtgcagcgatcgcttgtgatgtatcatcaatcattggatccaaatgggaataatagacataaagggtggcaataaaatgacaatgatggtatatggcagttgaaaatgaataggccgccgactcaatgcatgccctaacaggcccctgggccaaaggaaaaaaaaagcaacttggggaattgtacatggagaaaagatccacatccagtgggtatatatagtggtctggacatggaaatcaaagaaagcaacatcaggtttagacgatggggttgggattaccaccgcagaattcgagaatcaaccgttcgaggtcagagagtttgtatggcttcgtcatatagcctttgatacccactctggaggcgcgattcaatgcctcgtcgctaacatcggcactcacagcaagaactgtgggaggtggtggcgtacaaaaagagttgggaattggatccatttccatggagtcaggactgttggggttcggtcgctcaaaggcagcattttggttccgatgattgtcaaccatctggaggattcgtgaagtggcttcatatccgtccatttcaggcatccagaggtccatcaagacgacatcaatctgttttattcttgcagttgcagccagaggtggctggttgatgacgccttgcatcgcatgttctggatcgagaccaatatcaaggacattggaaggctttgacgcagagaggatgccttcaacgatctggaccgcttctttgccatcggccgcttcaagtacgtcgcggtagccaagtttgcgtagcatgttcaccaatacgcgccggttgattcgattgtcttcggcgaccagaaagcgcagtggatatttctctccaagcttcttgtcatatgcatcgctggagatacgcgttcgatggaaacgggtttgtgatgatggtcgcaaaggtgttgggctttgagacatgttttcgtcggtggcacacggtgtcggctgttgcagctgacagttttgggggaggataaatggggaattagaggaagaaggatcagacagaaggctactgacactgccctgtcgtgtttggtcggtggtacaggtagatggcgtcgaaacactctcgctgggagtggcagggcggagctcagtttcacgttggtttacggggattcgaattcgaaactcagtaccacgcgtaggaccggaagtcgacgaacgcacacatgtcaagtcaccgcccattttgcgagaaaggcccttggccacaagaagaccaagacctaggccatctttacttcttgtggtcgatgcgtcctcacgagcaaatggcttgaaaaggttgggtaggaatgcagcggggatccccgggccggtatcgcggacaagaataaggacatcattcctcttggggtcaatagttgcgcaaacagtgatggtaccgttgttggtaaatttaattgcattgagaaagacgcacgagattagtttggccagatcacggtcatcggcaagaagggtctcaggtaatgaagggtctacggaccagtccacaacctgggtgaacaattcaccgttcgaggaccgcgaccgaatctcaattctttcgccaaactcggttgcattgctaacagcagaatccggtcggccaccaacatgaagagactcgtttattaccaagcgcagaagatctcgcaacttggtaaaacgcaaagcagaacccctcaggttcacattgatgccctcgaggagtaagtgaggtgcggatcgtcgagctgcgagagacgggcgtggatcgaccatgttagccatcacagcctcaaactggcgaactgggatagcatgtacgatctggtcgctttcgtggacagcattcttgacttcttcgctgcggggcgaaagctcttgccgcgacgaagccgcacggagtctttgcttgcgtactggtcgggtattcatgtccggtggtaggctccgccgccgtttgtatggatttacagcgatattctttccttcaaaaaagatgctcgggcgggtttcgggtatagtagttgggactgcgagaccacccagtatatcgggctcctcccggagtggtgttttggggacttgcatgttgagctcgtatgcatgaacgacattgtcagcggcttcaacagcacgtctcgcgctatcttgaaccatctcaatcccctccttgagagattggaaaatcccgcccgatttgacaggagttttactctccatcgcctcgcgcactgtagcgtgcatgacatcaagcattcccaccacaccctgcatcggggttctcagctcatgggacaagcttcgggcgtagggtttgagggggtgggagttgaaatcagcggcttcatggaaggcggcagcctggggattgtgaaaatcaaaggtatttgtcgttggggaatctaacactgcatctagaacttgttcccctgggtctagtcgctgtacaatcaggtcttcgagcgagtggagaatcatttccaggaaggaccaggacaggtttctatgccgaagaccatctttggaccacatcaacccgagatgcgccaggcattttccagccgaaaaaaggggaatcgccaagtaaccatcagcggcgaatggtaaattatcatcgccgaacgatacaagtgagctgagattctcggggatcaaacaaggccgctcgtggtccatatgcaataaggggttcccgcccgcgaaatacctgtttcgctgcaaaccaactgtctgataaccatcgttgtagtagaaagccgcgccaaaaagcgacgggcgccgcccgcctagttctggcatcggctcactcccgtgcaccctccgagcaacaaacccatactgggctttggttatagatgtcatgtcctccataagccgtttccagaacagctcagtgtcggacgcccgcaaaccctgtttaagtgtgaccaaatgttcaatggcagtggtctgagcaccatcgttccacgtccccaagtcgcgttgaacatctccatcgtcatgaacggtgtgtatcccgtccccggtgatgcactctgacttgcaagagggaaatggcatggtgggacaaggttggacagcatgagagacatccggctcgggcgtgtcgggcatagtccatgtggcaagtgaaggtgaggtcggttcgaggattcagttttcggggctcgtagttgtccgagggtaacgaccgtagcattcaatggtataaatattagatacggtggatggatcgagatgaattcgacgtacatccaccagtatatgaaataatgaagagaaaaggcccagaaggattcctagaaggaggggagaggggattttccgttcggggggccgggcggtctagacacggcctgaaacaagagttgtcaagagctcatagactctgtagctaataatatttctaacagaaaatgtttcaggcttctctgagatcctgtagtttccttttgatgcttctcctctttgtgtgttgtggtttttctcgaatcctgcgaaggcgcacggaggctgcgcggcgggatctgcgggatctagaccagaagagggccattaggtactaggtaccttgattacccgagcattatatatgtggataggggtaccaggtacttccccaatcatctatagaacagatctactcccatgtatactcaaaacattgtatactgcggagtactagtagtatacatcgtagggactctctatgcttcctctctcattttttttttattatttttatatctgaatgattaacattcttctatatacacatagcgacgttgactccttaaccgcaatataccaagcaaaacgacaccccgaatccttggcatctacctaggtactttccaaaatctcacgagcatagagtgttcttgttatctcaacgtgaaacacgttttcatcaacctcattccagtgggtcttcatatggaggttgcactcatagcattccttcgatcggccattcttcggacgagatgttgagaatgttgggagcatacatacatgcgggcagccaaaaaagcgctcaatcttcgggcaatcgtttgtttcttcattgtaagtaatttcccattggctccggactcgcaaatatgtctgctcatcttctaagatgtagatcttctggtcggcaaccacttcgggctgtattgtgactgagcaatgatgccattcgagccatccatgttcacatcctttcagcatttgagccattgctctgatattcagcggactgcagggacagacgttcacaaatccggggtacttgcaacgatgatctatcccggtactatattccccagcaaacaaaatttcgtgggtcaggtgtaacttgctgcatgaggaacagtagagtcttctaggtccttggagccgacagagaagttgacggcgtaaatctagctgccgttcccgaacggaacttttagctaggaccccgaatggaagccaacctatgccgaattgatatcttgggaaggcaaattcatcttgtgccaaaacgtgttgatagcgtctgtataaagacctgcagctgagcgcaaggtaaacctgagactgtatatcgagcaggttgattatctggtccattagttccagaggcaggtccgatatagaagtgttcagctctgttttcggaggcagatccggcataggaggctctgggtgttctgtttctgaaggcatgttggtataactcgaagtagaccaagagaatataattgagaactctggtgatagcgaggttcggcatgggcaatacttcttggcaaagcaagaagcaccgcaccttcccttctaaggaatcatggccggttcctatttaggcaatatcatgccgtcggacactcagctccatggatgtagtgaatgctaaaattgactcttaaggcttttttttccatatcttttttggtagtttttcactcagtctgcaagcaaacaagcctgcacaatcaggtatcaatgggatgatcaaacaacaatatgatattgatacaaacttccagatccacgagtctgagaactcaacaaagtcatagttacgccttcaccttctcattttctgtttcttcactctactcatataaactataatctctgatcagttttttctcttttctttttgcactcttgtcatcaagtctccacaccaacatgtctattatgggatattcagatctttgcttaggcacacaggtgaccttcaccactccctcgcctcagaagtgggttctcgaggagaagctcaccgaggattttcaaagaatgaccaaccgtgaacttgagatgggtggtggaccttccttcgccgtgttcaagtacctctgctacagtccgacagacagtagcaagaaggcatttatgagaatttactttcaaattcccaaccccggaacagagtcccagtccccccagcttcgacaacaacaggcagctccaccccgtgagcatttggagttacaagctttgaaggatcttagtgaacaacactgtactgtggtcccagctctcctcgcctataaagaagaaaagcaaggtcaggacggcgtggttccagacggctacataacatatattgtgtgggaaatggtcagcgggaagccacttgatacggatcagttctggaggcctgaatcggcgcagttacgcgaggccgtccgcacgaagttccgccatatctgggagtatatttgcagaatcccctttagcgtgttaagagtgaaactaacaaacctaagagaattgaagcatcatggatggcagccagggctccctcttttgcagaagattatctacgacgactcaaccggggatatgtatgtgatatacgatatacactattaactataaagcagaatataccaactatctttaggcatattgcaggtttccgggaccccgaccgcttcgatcccggcgaaaacttttccgacatgacctttgtcctctggcgtttaactaggccacccagaaagtccggttgggagaaagaccctaccaagtgggcctggtaatcatcatggatgttcttttccccaggtccaatgcgctgcggcaatgaattgaatatttgccgcaattacatgaatcgaagttgatatcattgatctttttcctttcgggtatttctttgatatcgaatgacgacccaagacttccaatttgttaactaagagtttgtccgcattatcgggtcaatttatctatataacctcatacgacttccatccttcgttgtccaacatctgcccaggtgtaccgtgaaaccgaggtattatccccaccgcaggcccgagcgcgactaagagcataactggaacagccatcctgcaatgtgcataagcacctatgaatacgatgacgctaccgtagaaaaggtacatcaacggagtacatggcaaccaactttgcctctccgatcattcttaatcacactccgatcttgacgcaatccacaactatgacctcagtcaccccatattgcatcgctgtttcggacaagaaactccagcagctccaccagaagctggagtacaccacattccctgacgagctcgaggcttcggggtgggatatgggagttcctctccatgagatcaagagacttatcgctgtgtggcgtgagcagtttgactggcgtgcgcaagagcagaagttgaatgagcaactcccgcaagtcaatgttcgagtaggagtgaaaggcttcggagaattgaatatacatgtcgtgcatcatcggagcggaaattcaaaagcaattccattgctttttattcacgggtgtatctagcccttgaaacttcaccggtgtctccatcgcacttgctgacttattgttcctataccagggcctggcagcttcctcgaagctaccaggatccttccgctactgactaagaacgatggggatggcccagtattcgatgttgtcgcaccttcattgcccaatttcggattctcggaaggcgtcaagaaggcatgttgatatgtatcatcactgatcaaatgcatcctaacgaccaaaatagagaggattcgggctggcacaatacgccgaagctctacataaagtgatgatcgcactaggctacgaggaatacggcaagcactatccgaactcatgaaaagagcccgactaactctagagcagtgcttcaaggaggcgactggggcagcatgatcgcccgtactatgtctcagtattaccctcaaagcacccaagccattcacttgaacttcacgcccgtcataccaccctacccctggcggagtccctaccaattcctcaaatcgctggtatctgtgccattctcagcgaaagaccgtggctacatcgcccggacaatgggatatatcacccgcggcaacggatacttaagacagcaagaaacccgaccacagaccctaggctatgggcttcacgatagtcccgtcggattactagcttggatctatgacaaaatgcacacgtggtccgacaagtacccctggacggatgaggagatcttgacctgggtgagtgtatactacttctccacagctgggccgacggcgtcaacgaggatctactacgaggcctcggcaccgaagagtagtggaaatgcggctgtgtcggaggatggagctcagaatgatctgctggaaagaacggacgtgaattatatgtcgatggaacaagttttcggggcgcgggcaccacagaatgtccgctttgcggtggcgcagttccgggaggagattattatgtggcctatggcgtggtatcggtccattgggaatgttgtacaggaaacggagtatgatcgtggtggccattttgcagcctgggaagtacctgaattgctggcatctgacatcaagagattcgtaggcaatgatggaccagcctacggggcggtagccgacagagatggttattgaaggtctcactggatagccgcttgattgagtcaattgggggataacctacccaggtggcatgtggcctgcatagcaacatgtgcttctttcccgtttttatattcaatattgtcttttacccatatgtttgcttgcctctctagtctgacctacttgccctcttttgagaggattgtgttcattctgatatccgagcgacgtcatggaacaacaaagcagacctggtcaaaaggccacttgagaagttggacacttgggtaagaaaacattgtataagagcaccattattggacagactaatccaaaggtattgcccggggaacaggcatctagctccccctaaaggccttctggacacaggcaactagcatgttacgaggcctgaacaaagacagaggtcagtcaaagctgctcaacagaatgggatggttactgatgctcgaaagctggacttcatccgtttcactggttaatgcgttggattgataatgcaaattggaacactgccgtgacgtgacaacggggccttttattatcgtgatagaagtaagagaaacatggagtcaaagaacaaattgcccttcggctcaggtatcaaccgctctcacgttgctcttgtgctatcccgtcattgattgaccgtacacggcatatatcatccagtgaagaccgcagacgccgggatttgccctcaaaccaacggaaagcccaaaacaaccacttccccaaatctaatcctgtcgtcccttcaataaccgctgggtaaccttgtccttctctataatgtaaacctgggcaccccatccggagagagcatctcggtccacagcgctaagcagtgcttgtgagattgtctcgaagaggtcctcgggggcctatgatgacaaggtgtgttagaaaacgtatccggtagaaggtaagatagcaccattaatacataccagatcaggctcccacagaccctcgcaagtaccgaagagctggtcacttgctgttccgctgacaatgaagtccttggcgaaatcgatacagccaatgctgtcaaagccgcagatgaacggcttccccgttgttgggttgataccagctatcacagggctgacaaagtaaggaccgaagcgcttctcatacagcgatgagctcactaggttggcaagggtctgcggtgcgatatcgcgctcctcgcgcagccggtacatgttgaccttgtaacggaagagatcggagacggtgttgacatcggtggcgaggccagtcaggccgaggtaggtggatggagcgtagttgaagatcttggggaagttgttagagatggtaagggactgcatgcccaggcgaaggtcacaggcgatggcgacgcagtccttgcccaccatggcgacacaggcaccgccatctgcagaacgattagcatttcggttggttattcatgagggacaaagttccggcatactgatgtcgaaggggttggactgtgatgggagaagtcggtcagctttgaggtccagatattcgtggacgatagggacaagggcgcatttttcttaccattattgcagtgattcaatacaattcaatatagcgaagagattccagagctaaaaagaagaaaaaagaggagaaaatgtggttgagaaggggtcgggttggggggaggtgatggaggtgagttgatgacggggaagctctgaggtacgcgagagctcagatgacgcccgcaccgctgcctgtttcgtatgcgaccttcgactactttctgcgcctctttctccccgcattcaagatttacacttctttacttcaatttgtccatttcaaatctctttattgagatactgaactttctctatttattgttagagctactgttctccatacacaatgagcgcccacgttgtggtgatcgacgcgacagccaggcgggcaacaatcaagactacgcccgccaaacacttgaccgatatcctacaggaggcatgttcaaaacttggatataatgctagccagtactcattaaagtaagttagtcttctctactctccaacgacaacactgacccggtctattctatgcaacagacacaatcgcaagcagctagatctttctctttcctatcgtttgtctggtctcagctctggcgcaaagcttgaacttgttcaaatctctcgctctccatcggtcgtaaccgttggcctgcaactgcccgaatctgaggctcgcggtgccccgaatggccgcatacttgataagttccccagtacaactacactctggatggtactacggaagtttgaggcgggagtcgcagggactggtccggcacggaatctcacttcacgggcagtgccctctgcggacggtggagatgtcgccggacgattgtactatgagatccccgtccttcagattttggagcgtgaagtatcgagtttcacagatctacaaaaaactttaacccagctaggtttcaacagtggcaatgttcttattcgactcagtttccgacggaccgaagagcctatcgaagaagccatggccaagattggcgagttcttcaagtcttcagaggatgaggctccttcagtgcaggataagaacacagcgccatccgcagcgccggcagcagctcccattgacagcacaagcaaggaccctgttcaagagccctccagctcattgcagcctcagccctccagcgtcaccgccgcatctgatgttgcccctcccccacccatctccgaaccggctacttccacagtagactctggccgaacgattactgtcttttcccctccctcagaagacactccttcgtcggcgaaattagactacaatgagagtgattacatacccaccatcgagcacgcaaaactgcaccagcggttactcaacgagtcctctcgcccaaagcgcctgccaacggacgccgagatcgccgccaaggaagaggcagaagcggcaaggcgagcagcaattcgcgaagtcaatgtgaaggttcgcttcccagatcagagccaagtcgtcgccaagtttgggacgtcggacacaggactgtcgttgtatgaattcgcacgagggtgtcttgcgccaccattcgccagcgagaacttccttctcactgtccacggtgtatcccgatccaaacatacgaacgccatacccccatcagacaaaaagcgtctgattaaagatctagggctggctggccgtgtgctcgtcaacttctcttgggctgacaacgctgcctcctttgttcatggacgccgagcggagatcctacgccccgagcttcggagccaggctcaacagctcaaggtggagcaaccgccggagctcagggaagaagatgtgcctggcccgtctcggcctggtccaagtagcgctcagggcggtgataagcccagcggggcacgaaagagtggcggtatgcctaagtggctgaagctaccgggtaagaaatgaaatcgagataatggaatgtatttggttcaggtgagcgacatgtgctgctcttgatgatcatgacttgactatgtggcgtatctttggagacgcatcaaaatcttatgtgcagatagacttgaatcacatgcccttcgaatatcatttgcatggctacctcaatgacaatgtaacgacctacctaggtagactagacaccaaatgcatggtgcatatgcaatgccattgggacattgttgactctgcacacatatacctgacgtcaagcctcactcagctatacttaggcaatcatacgcttttccatctactttgtaaacctccatttagaaagtggctcaattgcaaatatcacacgtgaaatggttgaataattgttttcattatggtttcactccatacgatagagaaggaatcccatatttgccttcccctccatgcacgcccaatggccacgaaaccccctttccgatccgagaatcacgctttttttgcgtcgagtcgttaaaacgaaagaaaaacaggaacgggtcggaaaatttagtgagcagcaccggtgcggcgagactcagcaataaccttctgcatggactcaaccttggccttgccgcggccgaaagtaccgagctggatatgaagttagtaaaaggctaaactcaatggatcgactgggcgggctctgatccttgtggaaatcgtttgattttggtcataaatctcggtcgctggtgtacagaacagtaattgcacggacttgtcaaagcagagattgaaatgaatcttcctctgcaggatcgacgcacatggcccatacagtacgactctggtacaccaagacctcaaccaaaccgacccaaatccaacgcaatccatgcaacagagccaaccagacgaaaacggggaaaaggttgagagtagacgtacgcgcttcttagcgagcttacgggcacgcttgtcctgggcgttgcgcagcaactcaatgatgcggcgctcgtagggagcgagaccaacgacctcctgggcgatttcgcggacgaaagcggtacggcgggaagacttgcccttggtgcgggagatgcgggtcttgggggtgttgagggcggtggttttctatgtcagaaaacagtcagcatgtctgtttcgccaagtctcctgtagtggccgcaggtcccagtgttctcttcaattcgcgtttcgtgtctgttgtcggggtagttcatggtgttgtccgatcatgggtgtaaggcgagtactggcttcggtgccaaagttgaatccaaaaaaacaagtgttcccgtgacatcgaaatcttcccagcgagtctgatattttccaatgggcgattcgatcccaatcctccttgccgtgataattcccagtgtttccgcgatagccctggacccgactggtcttgagtggaccaacagaccgaacgaaaaagaagagacattgagagaccttcaaacgaccgaaaaacatggtgcaaagagacagtaagaacgtacccggcccgcgttgagtccgaccacaattccggagcgttcggccatctcgacggttgttgactgaaggggttggcggaggttgtcgaagaggaggtgagggagccgtgtgaaaatcgcctggtcttttgcctggaaccgcaaaatggagccttggcgttggtgcggtaggcgagtgactagggctagggctgtattaatcgggactagcgtatatttctaacacctcaggcacttacatcaatatatcttggcatacgcacgtgatagagacttgccctctttttatagatcctcctcttactacctaaactgcatttgactcgttaacagcaactctgtgatggatttggtttacatgtactctaactatgtattttcatggacacatgattcgttccttgcatttcccgacactcaggaattaaagcctggcagccagtactccatcaaatgcctcctcccagctctccctcagctctccgcaaaacaattcgagcgcagattcgtccatcaccttctctaacacgtcttggagaggtttctcgtattcatcggttgcatcgccacacttgaccatgtcgatgagtgtactgagagtcgctgattcgacaaggctctgtttcaaacttcgcgtgttcgaacggacatcctcgaaaacctcacggacaagagtattcagtcgctcaatttgttcggcagggagtttggcagtcttcaatgcctttcgagaatccaggtcgaaaatattccatagagccttgagggtctccaccagggtccagatggcatggaaatattcccatgtcggcgcacccggtgtaccttgggtgaacttgatcgtcgttctcatgataagagaagtcttcttggtgtctcctagagctaggtcttctctcttagccttcaaccaattctctacttcaccaagagcagtctcaatttcggtagaagtatgggccttggatccagccataaacatagccactttcagtaattcgacgtggatcttggttgcatccctctcggcgtcagtatgatcatctccagtctgggagagcgacaatttgtcgatttggggcagctctagcttcaaaacgactggcttctgactgccgatgctctcaagaacactgaaaagccgatcagtgagccgggcggatgccagccagttttcctatattgacgttagtcggtgccgtggtgtcactcaaccaaaccaaacttaccccaggaattgggcctgcgcgcaatcggtgctcgaatggagatcgatcacaacgttccaggttcatgaaaccatcatacttccggcggtcttgagccggtgatgtatcctggactatatggtagttagtattcaagtatgccaggagtacatgagagactgagaattgctgaccgatgtcttcgtggaggaccaagtgatttcctttgcgaattctttgtatccgccgtaaatccagggcccacattctccggcagatactgtccccgatacgtctgcgaagctcgattgtgtcgtctagaccgacataatttccatcatcgagtccttttatcaacgagtttttgatagtgacgtttgcattacgataaaagtcgagagcggcgataaatgcgacttgcgcgtcaaagtccttgtactctgcaccctcaataggaggcgcggggtgagggtggatggtggcaaagcgggtgaagaggttatgagcaacactctcatactgcatttgcttgacagacagcttgccaaaccacctcaaagcaatggaaccagcaccgagaagaaggtaaatgcgaatcaacataaggactgcctcatagttatggggtgaatcgattagaagacgttccagaataccggcggcgcgaatcagggcagtgttgttgactttctcggatgtctggccaactgggataggctgaagaagggccattgcggcaatgatgcagaagtcatctgtgggccgactttccatcgtggaagcagtatctggttggctttctttctttgggtcctgggtctttgctagaagggtgaatgcatcgtaaaagtaaaggcagttgcgcacaagagtctcgatgctggatttcgatgcgttcttgttgcctgaaattcggtcgcagtaatgcaacttgtacgcgttgatcaatggaatagcatcgtcctggaaagtggattagctcgcattgactgagtttagcagattttgcacttacgggtttcccctcaacactgtccatgcaatgttgagctactcggtgaatcaaagcatcatcacgggtctccaagacccctcgcaagtctttgaaagcatagagtttgtgcttgtgttggtcaaagtatctttggcacacaacaaacagatcatcctcggtccgctcgccccgtttgaacccggttaggactgtgtccatgagggcgatgtgcgcattgcgggacttcgggataaattccatgaacttctcaatatgctgctgtgtgtcggaaagcagcctaccaagcaagcaatcatttgttagctgaaattcaatgctgtggaagtagaatattggaatacataccccggaactttgtcaagatgacgcacagctacgatgagcaagttccagtatttccaatcatcgcgctcatgcagagtgctgcgctctgcttcatcttcagatacggcaagcaggcttttggcgtatgagtgcccttcttcccagagttcggcaagccccaaggcactgattttgtataggatgaaggtcctgtcattattaacaatccgagagctgagaccaacattctcgctattaaggagctgcacaatctctgcgaaatgaccctgcgtttcgagaattcgaataaccaagagaagttcctcggcggtttgtatggctctcggagggcttaataattcggtctgtagtaagccatttgaataaggcccagtcagtcattacgtccaaaccgtatatccagtgagcatgtagtaagtaatcacataccgggttagaggggacctcggatactgccttttgagcaaagcgataggcaagtgtgccaaacaatttgcggtccacgtccgaactagccgcgtcatctgaaacgagataacaaaggaaaatggcccagaaatagtactttcgctccctaggaaagttcttttgaagactcatggcagcctttggtaggaataaagacactcgttagcaatttagaccttgatacgatgccggcgtagcatcggcatcttcccaactcaccttctgggctgacttccagtcaccagcgtcatatccaaacttgaaccatctcatctgaagagcatgatcttgtggctttgccttagctgcccgttcccatatggcgctccgaagctcggtatggtcatccatattccgcagcgtacggtggagtatgtcgagagagtccaagtccgagattggcggatcgacgttgcacagctcgagggtctccgcaatacccttctttttatgagcttcgtccgcatggttgaagaggacattcgctttccaggcctgtttgcttgttagttggtctcttacaggtgccagcgtcgcaggagtgttaggttcggaatgaacaattatggggatcactcgccttcaaaaactgagtattctcgcctttcttcatgcgcttctcaatcagctgcaaggcctgcttcatgttctgggagtcaatggcatcttggatttggttgttgcgacgcagaaacaccgcgtcattgctggagctcatggtgaaggtgttgttcaatttgtggggaaactcttccaattgtcgtcttttgcagagtggtccgatcactgtgccgagcacagcatgggctaaaagagtcaatgatctgagttggagtcgagtgatcgactctggtcacttttttatttggcggggaatgagacacaaacggtaggcggtcagttggtccccgcaccatactgccgaagtatgagtttgggctttcatagcttcaaactttcttgtttagttagtatagattacacatatgtatgaattaagataagaagtcacactccagacctatggataatccattttaaaatcttgagacatggttccccaaggttgttgggggtttcagaggctacctacttccgtccttaagaaggttctgacatagatgtagttacatgtagttttagctttgatctggttatctctcgtatgtgtacaaggattgtattcgaattaacatggaggtccgcctggacaagatagtcaagaccaaggccacgagaattttaatatacagacttaaaatgattcaaaataaagtccaatacgccatataaaaacaaagttgcttatcttcgctggtcagcagcggaccgtgagactgttcgacttgccaaaaaaggtatatttttaccagcagagcaagatcacaaccccgacagcagtttggatatctaccatgtagcggttcacatgataaacaccggagcttgacctttggaagacttctaattattaggttggtagaaaagcacatcgtacacattggcatgcaacaactgctttgggaatgtcagggatcttgccggccagtaaacctgtcgacctttatggtccgagatgatagatatgtctcatttgggctgaggcgtcaaagaaactttcttctgagtgagctgtgcctggttagtgaccgaatatactttaacgtgtccgaatcaaagtcgatggaatagatctcgcggatgggttaccaaacatgcacgaggcatgacctcgatacggagctctgtattcaacttacccagttctttttgcaatcgcgataggctctagtcaaagtaatcagtcagtaagaaagctcaggcatatgataatcgtggtaatatagtacaagctggtcagaagtggatcgaaagccaggtacgccaaacggagagcaagtcgatcttttagatatatcacgtaagggttttcaacgtactggaaataatcgtggcacatttcgcggtcaaaggcattccgtttcatacacttgagactccgatctgcgaagtcttggcatggatcatagtactcgctagcatgtttactgaagtcgcaagttagctaccagtatggataaaggccacacgaattcagcccagtgaatatgcaaccgtcgggctagcccgtgtggttctcaagaccccatagtccatgtaaaggtgatccgcgaccacgaatgacttcagaaatgtcataacatgtttcgggaatagacacaagcagaaaaaaggtggagggaagaagcttgaaacatactgtgtgaacttcttctccgctttctcccacgctttgtcgtgagtgtctccttgtgtcgactccgctgccatggtgcagtgaggtggtatgtctccagtgtttgcaatggataattgaggcaagcaatctaatcaaataaaatagaacgccaaaccgtcgctcgaaaaccagattggaggaggttcattggagcagaagttagcgttgggcggaagaattggggatcaagcggtcttggcacagagatctgcgaatgtaccccaactggcgtcccgaggtccgcataccaccatgtttttgagtatgtacaataatatactgctctgggcttcatataattctagaagagagttctagatgagcatagctttaattatgagtgcgtctagcttgtggcccactgaaatagctgggcgtgctattttagagtgtagccttccagtctatctatatatatccatccacatgctccatacaattatgatccatataaatggcaatgagagtaagaattagtacatggattcttctctcaaccagcaaaaaagctttattatgacaaaatagtactacttggcttggaagatccgaaagatgctgactactgcgatgtttcgctattctctatgactgctttcactgctaggtactatctctcctccgatacaatgcgaatagatgcgagactactccacaaggccaaagccgagtcacaggaagatgaaacttctaccgtggactagcattgatagttattgcttcgtttccgtgactatgctgtccacttgtaatgacaggatcggtggtcagactgctctcagaaatgaaaatggcgaggtgatgaatgtgaaaagggccacaaatggtatgcatcctgaccgtcatataccagttccccaaactcgcaaagatagggttcggtcgtggtttgaaagatatatcgagcataaagcgcttcgggcactgggtataccaaagtagatcgcaacggtgacatatttgcgtcaattatcatccttgatggatgataatcttctcacaatggatccgtacggctgcgatagttggtgacttgtgtcatcaatttcgcggagtatcgctctgagatgcttctgggtcggttccgtaacgctaattggttcattggaactactagaaacgagcagggcatgtatttcatacggccagtctcaaggtgtcttccacgagcgggtatgttttctggagtatatggaaaggagattgttgaagatgacgaggttcagctgggcgtgttcgatgacagccaccttcgctcggagggactgaaatagcaatgacacgagaaacagcgaagccttcaaagttcttctattgtgctgtataggaactttgtgaatgcgttagagactgttagggatgtatgatcggtaagtgagtcggttgatgcaagatcaagatgtataagtgaggtcgaatatgctttgatcggctatattatcgaacagaatttgactcatctagtccaattaggaatcaaagaaaaggcgaagtcaaagacagggcagcatcttcgtgttttaagatctctacaggctttgttcatatgcgaaggtcgctcacctataagagatgtctacagttgcattatgcagattgaatccaactctaaaatatacgcgagaaatccgagataattgtcatataaagcccgtaaagaaaaagtgacgagtcacatccaaagttgctagttcagagctcccttgcccaggtgttgggccttcctcatgattatgttattgattgcctgaggccacaaaaacacctgccctctcacttaaagaatctggatcatattattactcttccttgtgcctttctttcaatctcagaccgtcacgttatcgtcgcagcgttcttcggcttcctagtgtttgtcgctgcgaaaagctgttgatcacaccttgccgccttgcgaaagttttactttccgggacgcccccaccgcatcctgtcgacactcgcgctcgccccgaaacgactcaaacacactccggtcgagtgggccaggctcctagggtggaaaacggagcatctgacgagccgcagaaagtcgaaatggcagctagaaatggttctggggccgaggcgtcgggagtaagtccattcccgtatctgatcgaagtgatcgagagctactgactgacgcgcactttacagctcgtgaacacactccaaggccatgtcgatgatattcgcactctgatacagtgtggtatatgcatccgtcccctttacgaaccgtttactatcgcctgtgggcacactttctgctactcagtgagtcccttctattttactacctcgttaattccattacctgaccagaattcttcacatagtgtctatcatcatggttcgctggtggaagatcaaaacgaacatgtcctgattgccgagcacccgtcaaaaatcaaccagcaccagcttatctggtgagttttaacaatcttcaattcgtttcattatatctgacatgtctctcgtgttacaggttcgggccgttgtgcagatgttcacgggtcgcgctgagcttttagataaaggggaaaccaccacagagcatacgaagaaccaaagggaagaagcagaaaaactggaccaggacaaggccaataatcatccaactgaaggaggtctgttcgggggccttttcaagcccaaagctcccccacttaaacctgtcattgacattgatgacggggtggttcggtgtccggtctgctcgtgggagcttgaaggagacaattgcgcaggatgcggatatcgataccgaccggagtctgaggagactgatgacagtgaatcagccgattatagtgagaccgacctagactcgctggatgatggtatggatgaggaagagggtgagaacgggggcgagggaggggaatctgaccacttcgacgacatcgaagacaatgatggcatttggggcaacttcgcgcttcagtattacgggcctactttcaatggacgctctcactggccaccaggtcgtgaccggcaggctttcgaccggttcgaaaacttgatacgtggacctcccatgatcccactgggggcgcagtccccagtggatcatgacaattatctcgcttcaggtaacaccaatggaagtgaatacgacgaagaggaagaggaagaagaagaggagaatgagtatgacgagtcagactcattcatcgatactgaaaacgaccacccgcccacgagttcgttcattgaaagtcaagccgatcgtctcgggagtggccatatgtatgaatcggaatcagaccgttccactggcaccgttgtggattatgttgcgcatgacagccttgccaacacgcatgggctccattacagaaacactacaccttactttgacgatgaggcttctgatgaagataatgaagtggaggaagaggaggaagaggaagtttcagaggcaccggacgatagaggtatggtcaatgaagactcggaagaatccgatgaagacgcagtccagactgcgccgcctcgtcaagccaatccacaatatccataccgatccccctggttccaagcccccagcgctgctccatggcttgcggccaggcctccacctgaaccaattcctgactcatccgaggaagaagaatcttcgccgcctattaggcctgctagatccagtgcgcgtcgtcacgtccatcacgggaccacggctctgaatgcgattcccctggatgattccgacgacgatcagcctgtcggtccagtgagaagaaccacacagaggcgacgtgccagattctctccatattaaaatcatcttccaaccgctaatgcggtatttgctttcgcattttatggcctacttttttcctctttttttgggcttcagcgcggcgcctgggtaatgctaagaggactgtggacatggttggcgttttgtcttgattttgatatcacaaggacgacctttttctcttttcctctctttttctgcagccttcaacggctggatcctatcttcatgtttagttttttttttaccggctcagccgtactctacgaatacccctacttacatatccttcttcggttcgatcttggtcttttgccgccctttgctagtgaagtcgaagaacctagtctcttggcactcaataaagcgtggccacaaattccgtcaaatccatgaaaaaagcctccgggttctaccgtattgagtccttgtttatcatattctgttctcccgccaaactagtagagagcacaccactgacttgcttcatagtgtaattgctaagattgcttgttatgtctgaatggtaactccatgcctgcgacagtctaccaagtcctttcagagttgacgaatgtatccgctactgactcacctggacaccctattcacaagcaaatcgaaccgatgagaacagccaggcaacatgcccacatgactcagacccggaatcataggaatctttggctattggttgttggtttggcgttgcgagattggagggaatcttctgatcgtttaccctaatcttgaagttctactgttcaggcacaatgctgattgaaagagggatatggttgaatatttcaatgcaccgaagacatccggcacatatgcaaaaatggtaaaatacacagatgtgactccaaatacacctgaccccgagcaacgctccccattttactcggccaatgaccaagatcgagacagaagattatgaacaaaatttatacatcagccttcacggtgtcattagtagcaaatggaacttcgaagacaacagcacaattgcggcctcccgaagtggggccttcatggaaattgttggtgaagcacttccagcgagccaatcggtgctccttgccgacagcagcgacgatggacaaaccacgaggttcgtgctcggtctcagactttttggattcagcaccaggcatatcagattcaggccgtcgttcgaacaccgcgatatcgttgatgacgcccttaatcaaaggctctggctctttttcatcagctgcaggggtggcatcaagagcaagagtctgtttgagttgctgcgaaggtgtgtctggtggtgtgacggtgccaggtaagcctgcaccgatgggacccagagcgataagtgtctttttatcttctgagacgcgccatgcgcggatgaaaccgtcccaactgccactaaggacaacgtcggtacctggtagagtggcgagtgcggtgatccagcgaggcatggggcgcatgtggcgcgcgttgtgggcggcagtcgcctcgtctacctcgggtgataacacatccagaggggggatggggtccaagccgtgagcaagacggacagtgtagagtggcttctttttgtgaactgaccaaagacagagggagccggagtcggagccagtgacaaagtgggtaggtggaaggggggcaatgcagtcgatgttgttttcgtggtaaggggcatttcttgaggcgccgccacggaacacgagctgtgtttcgtcgacgaccttccacaagcgagcggtgcgatcccgagcaccaacactgacacattcgtcaatagtcatggcggcaactccggtgacgtgatcctggtgtccgaagagtgtttcgacataggcgtgacccgctccgctgatggaccatgtcttaattgtgcggtcgtatgagccggagaacagctgctctccggaactcatcgctgagatatggcgtgcaaaagacaagctgcaaacagagtctctgtgctgcaagaaggtcttgcttggcgtcaaagtctctgcgtcccagatgataagcttattgtccgttccaccggtggccacaaattttccagacggcgagacagcaacagatatgatacttcctgtatgtccttgatcttcgtctgattcgccaactttgcgcataccacgagcggacttcacacgcttaggcttcttgcgctggggacgcggaggccgcttggaagtatcattatcgccgttcaattctgtagagcctggtacactgggtgtagccaattcccacttggtcaaagttttatccttggaaacaatgtagacgaatggcgggtggactgcaatggcagtgttcgactgggtatctgagcggaaaaaggaatggggcgccgtgggaatggatagtttcgcagcgatttgacggaacgtccgtcctttgaactcatcgacgtccttcttcaaccgttccgcaatcaagtctcggtcgatatctgcagcatcgaatccagcttcgtcgacttcttcttgaatgttacccaagtagcgttcagcgagtttcaatctccgatccgctgcggtttcgccatcttcggagtccgatccactctcgtcgcctgactctgccgtgtcgattgcggcatcttcatccaagtcactgcctgagatcgattcctctctgtccttggtccgtcgaccaccgtcggttttggcatctacgcctcgcttttttgatcctggggcggcggcgcggtcgtctctcttcctcttgcgctgggaattgggtacagtgaaaaaggacgacatggcgacgttttgtcaagcctgtcagttcttgatctctgtataaagaaatcgaatgtctggcgttctcgaaagactcggactgcggagatcaaaacttcaacttttttttggcagaaaaaaaagcgctaagcggcggctgactcagcaggtagctgacctcacgggagctccaggcctcaagctcaccgcgcggccatcctcacttaaccactactcccattcgtcttctctgatcatctacttacttgcttttttttattttctatctctcataccgcaaacatgtaagtccatgttgaccttgtctccacgaatggttactaatagtttgctagggaggttcttttgggtatcgccggcaaggacttcgtcattcttgctgcatccaaggccgcaatgagaggcccgacagttctcaaggctgaagatgataagacacgacagttgaacaagcacacagtgatggccttctccggcgagtctggagataccggtatgtagcttcctcgatgagacaaacacggcgctaatgagatacctatgctagtccaatttgccgaatacatccaagccaatgccgcactctacagtatgcgcaacgacactgagctcagtccctctgccgttgccaattttgtccggggagaattggcgcgcagcttgcggtcacggagtccctacacagtaaacctgctgctaggtggtatagatccggtcactgagaagcctcatctttattgggttgattatctagcgtctctcgcgcccctaccatatgctgcccatggctatgcccagtatgtttcatggcccgtgacgatggacgatacagcagtccaggcgagagagacctgatgctgactctgctagatactactgcctatcaatccttgacaaacaccatcatcccgactgctcccttgaggagggccttgcccttctcaccctgtgcacagacgagctgaagcgcagactacccattgactacaaaggggtaagttccttagggagccatcctcgactgccattattctgacacgattatccacagatgctggtgaaggttgtcacaaaggacggtgtgcgagaaatccccgtggataacgataaggtggtccggagtgcttgaaaggtcgacataccacggcgtttgttgtatcacatcttatgacgtttttctttgattccgagatagtccaacggtcggcatgattttggctgtagcaagcttggaaatcaagtaacgagtagattcctagatggccttcgataaacaataggcaaatacaaccctataagctcaccgctcgaaatgaacagcattttgtatagaacgtacaccgcttggcattggcctgatgggcgtttgacttgtttgcatctttgagtcgcatcccgagctcgcggaaagtcaagaactccaagaccaccaacttttcgatccaaaacatctcaccatgtcaaaaagacaggcagagctccccttggagcaagacttttccggttcacccgcatcgaaaaaggcgcgcgtcgaggacgacaatgatcccggttctatcaacggcgcagcgcccgcatcccaaaagaccggcgaagagattagacaggatgatcgcaatggcgtggatatcctaggagcagctgaaatagaaggagaggagcttgaggagggcgagaaagatccctctggactctcggatattgacgaagatgcacctgcactcagcgctccgaagcggcaaagtgctcccatggaaggctacggcgacctgtacctcgacacgatcaaccgtgaaatcctagatttcgatttcgagaaactgtgctccgtcagtctgtcaaacatcaatgtgtacgcatgtcttgtctgcggtaaatacttccagggtcgtggaccgaaatctcatgcgtattttcacgcccttgaagttggacaccacgtcttcatcaacattggcacgaagaaggtatatgttttgcctgaaggatatgaagtcaataacaagagtttggaggacatcaagtatgtcgttgatccacactatacaaaaaaccaagtggtcaagctcgataaggaagtgcatgatgcctgggacctttctgggtcgaggtacagaccaggtgagagcctataccatgataggatcgaatgttcttttttcgctaatagtcttccgttccagggtttgtcggcatgaacaacatcaaagccaacgactatgtcaatgtagtagctcaactactcgcacatgttttgccaattcgcaatttcttcctgctccacgaattccctactcccggcacaccagagataattcttcgtttcagcacgctggtgcgcaagctatggaaccccaaggcgttccggtcacatgtgtctccgcacgagttactacaggaggttgccgtacgatcctcgaaacggttcactctcacgaaccaggcagatcccgtggacttcctgtcttggttcctaaactctctgcacctcgccttaggaggatccaagaagccctcaccaacacccacaagtgttgttcacgcagcgtttcagggccgtgtacggatcgagagtcaagctatcacggctcactccgacacccaaaatgcccggttggtatttactgaatctggcacaattaatagccaggttactcctttcctcatcctcacactagatctaccccccacacccctcttccaatctgccaatcgggagtcgagtatcccacaggtccccttgactaccctcttgaacaaatataacggctatacggcgtcagagaaactggcccaccgtgtccgacaccgtctcctccaccctcttcctccctaccttttcttccatatcaagcgcttcagcaagaaccgctttgtttctgagcgaaacccaaccatcgtcaccttcccctctccgcacggcttggacatgtctccctatgtcgagccaaatcccaatatttgctcacccagcgagccaatcctctacgatctcgtggcaaacatcatcctcgaccccgccatcgctgcacccggtgcaatggatgacgctgtggacaagggcgtcaacgctgcgtcaggagctggcggttcctccagcggagcaggtggcggcagcgagaaggtgtcatggcttgtccaacttcatgataaagctatggaggccgagaacactcgcgccaaaaatggcggttccacggagaagcagcagcggggcccggagtggcttgagattcaggatttgttcgtcaagcgcgcggaaagcgagacgctgttcactcgtgagggatatcttatggtatgggagcggcgcaaagtgcctgggaacaaaggaaagggacgtgcatgatctgagatagttaaacctgagttgactggggcttcgaacttgctattgtcttccacgtttttgtttttgagagcaaatccaatgtaccatcagctaatgaaaatgtgtaaatgcaaatctcatcaagatagcaatatgtgctccaaaaggatcatattgtacaaagtccctcatagttgtagtggggagcatggtctgaaattttactcggtgaacctaggtctttgagacccccgcatgaatgaaaatggcggatgtaagaaggggaaacccaccctaccagaggagatagaggaaacagagcaagtacggtagagtgacctaggtattaaaacggctaaaagaaacgactactcatcacaaggttccccagccgcagaagttcctccctatcctcatcgtcgagcctactaggaacccccaaatccccgctctcatcgcaacttgcattcctctcatgagcacaagtcggtaggaataggcacatatgtctggccaggttctcccgccaaaccaaagacccaacgggtggacgtctgagagacgggtaacggaggaaggatgtgagataatccaggatcgggtcaaggagcgaaggtagagtgcttcgagcggcgcgagtattatgccgctgattacagcagcgagatgagacgcgagggagtccactgggtatgccgaaagaagggtgacgcggtggacttgcgacaatgtgtttgtcagttgtccaggaatcagagaagagggtagaattggctggacaagggtgtcggattgggtgtcctcgttatggtctgtgtctgcgacagggttcgattcattgggtggctcttcctcatttggctcttccacaccatctgggagaatgtttggtacggtggaccctagagtttcctcgattgactctaaagtcggagcgtcggtggcttgggtttctggggccggaatttgagggtttaattcaggggcacccaagtcttggggggttgtgtttgatggtctggcagtgatacttgagaggccatccgtatctgctgccgctaggggctgctgggcctggcgctgggcctgacttatgatcagagcctcgaggaactcggctatggatcgtctgtccatggcgtctggatttgaacctggcacaccatttcccgctagtgcatttaactgggcaggatttgaagtttggatattcgagtgacggttccgattgcccattaactcaagctgcattgtgataacgtcggggctctggtgaatcaaggatgctcttacgcgaggcgacgtagggggtgatgtttctggtgatgacggttgagaaaagagagtattagaacgcgaactctgtcggtccacagcaaggtcctcaccattttgcagaggggctgattggtcctgctgtgttgaactggcggagagacgactctcccgaccagcagtagctatctcggagaaatagtcattgctcatttccccgggtgactgagacatacggttttcgtttgtaagcacctgattcaacccaataacagattctgcctgggtcagacgcatggatggagttgtatcatgtggtcgtggtcgtactcgcgatgcaagagcggcagcctgggcatcgggagtaacccctggcggtctaggcacgggttcatttgggccttctccagcaccaaggttgacttgaaccccgccaagttcgttttgcaataactcaattgaatggcgtagattttcaatcctctcgtccctgaaggaccgaagaacttgctgctctgacaattggttcgatctcagtccaaaaagcgacgatacccatcttcgaaaaatggccagttcgaacttgatgtcttcgaatagcgtgagcttgccgcggtgtaattcttcgtccgatctgcggcccagggtgggcactacccactctatcaggttttcttcaaacgcaacgcggaccgagagttcgtcaggaagagctggtttgggaaggtgccgtctgatcaaccgatagatacgctcttcaagctctggtcgcaggtagtagccatagaggaacactaaagcaccaggggagatcaacaactccacgagtgacatccccagtgagcaaggggagaaatctgtaggccaagatggcagctgtagcaaagattctctgctgaagggaagcaaaaattgcacgccagggattccatatggagacacaagggaaagggactggagtgtagagtacatgtagaactccatagacaacatgagcacagaatttctcgccctttattcatagttagttgtcttgtctatgtgaatggaggaaggatatactcacgctgtatacagaagcccgaaaaaggaacgaacaccgagtgagtcgcccgtcaaagtctgaacatagtcacgcagagagacaaacacccgtttcagcggggtttcgcgagctatagccaaagcactggacattgcccaggcaggaattcccgaaaaatagaagctaaaaatccctgtggtgtctctctcagatttcatggcactgagcaatgtagagtgggcataacgccggtaagtctaaacatcaagtctcgaatgtcagcccaatcaaagtagtatcggcagtgcatttacctgtactcgaccggtgactgaagaggtccaccaggtaccgaaaaagatgaacagttgatcgagggttgttatgaccagtccgaagtcattttcactcgcaatctggttgatttcttgctgttcattgggcataccagaatttcggtctccattgacgacaatccccattgttgaaaggatgtcattctttgctctccggagtcctttcccgaggcttttggactcaggattaacagggtgccctcgagtatcatattgctgcatataattgtctgcatggacgttggatatccgtcggactggagtggaggggtcaaccgccgcattgtcaggagcttcgtatggggaccggcccttgagatcagtcaatatagtatactatgcaatttataactacgttcaattagacatgtatgggtagaggcgtctggggtggggcttgtatatcaggatggaaacaatcggacagggcccggtggtgactggttcggtttcagaagactttaggcttctcgaagtaaagcatgaaccattgtcacagcccgtagacccaagatttctcagctgcgaatataggggaagttcgcgagtagaaaggtgaagcttaccaaagcgagccggttcaaataagcctgtcgacccatagtgcgcgtgatcaccgggctagtagtgtagccacgtggccttttaaaacaccattagtacgaattctttcagaaagcggtatgaaacacgatcagacgaaagcccagcggttgaaggtgaacatgtggttatgcggctagacatggcctgaggcagaagccatatcttatcaccaaacaaacggtgcaaacacccaaaaaaagttgcccgctcgagctgccgtttttcgcgatcgttcaatctctacggctcttcgactggccaatggcgtgctaaattctacttttttacgccgagttattatagagtcatgtcgaaagctattgtcaaaaccactttcgaggcgtcccgtacgctccgccccatttacaccggtggtagcacggcgctggatgccagtgggcgcatcttgctgagctgcgtgggcgaggatgccttgatcgtcgatttggagactggtaaccagctcactagcttggaaggggtatgttttgtcgccttgatggtattcttcaattgcaaagcgctaaccacataaacgctgcaggatggagaaattgtcacaggtttggccagtgagtattgtatgtcctgggaatgaggataaagcactaacatttcgtctagtcacgccttccgcctcgcacgctattgtctgctcgcgctcgatgtccatgcgaatctacggcctctcaactttcgacgagacttctcagaccattgaagcaaaacttctccgaaccctcaagcctcacacagctcccgttgtgaccattgctgttgaccctactggcacactgcttgccactggtggtgctgatggctcaatcaaagtctgggacatcagaggtggctttgttactcacactttccatggtcatggtggtgtcatttctgcgctttgctttttcgaggtgcctactgccgacagcgatgccaagtcatccaagaagaacaagtctaagcaacaggctacggatgacgatgatgaagatatggagggctctgcccgtatgggttctactgcaggattccgcctagcatcaggcagtgaagatggcaaaatgcgtgtatgggatctgcacaagagaaagtccattgcgtcgcttgagtcacatgtttcacttgtccggagtttgtccttctctccatcagagaacgcattgatctcggccagccgagacaagactgtcatcgtctgggatgcgcgtacttggaagactcgcagaatcattcctgttttggagagcgtggaagctgcggctttcattgcggatagcggactatgcgttatcggcggagaaaatggcaaactgcgagtttgggactgcaatcgtggaagtgagatcacagaggaacaagaggccggagaggagttcgaaagcgtcgtcgctatccagtattcgcctggtttgccttttgtcctcacagtccatgcggatcagactctccgcctccactcgctcgagtcactgtctgatcataagccaggctcaaccttggagcctttggcgattatccgccgcatttccggcaatgatgacgagatcattgacctggcttacattgggcctgatcgatctatgcttgctttggccactaacaccgagagtattcgtgtagtttcggttgctccctcagaagatcgaccatcaaatcagggagaggagtactttggtgctgatgtcacacacctggaaggccatgacgatattatcatttgcattgatgccgattggtcaggacactggctagcaacaggcgctaaagacaacacagcccgtctttggcgtattgaccctaaaacatcgtcttatacttgctttgctattttcactggccacgccgaatctttgggagcaatcgcccttccccgtgtgccaccccctgttggcagtgccgcatataacgaccccttgaaccacccgccagcatttttaattactggctcgcaagatcgcacaatcaagcggtgggatacaagcaagctagcccccctgacgggagaaaaggcacactaccctaaggcaatctatactcgcaaggctcacgaaaaggatattaatgccattgatatcgattctacatctgaactgtttgcctcagcatcacaagatcgcactgtgaagatctgggccgctgacgaaggctcgacggtaggtgtcctccgtggccacaagcgaggtgtttggtcggtgcgattcgccccgcaaggcacaccgattatcaactcagactcacgcactagcacgagccgtggcctggccgtcacaggctcgggtgacaagaccgtcaaactgtggagtctgtctgactacagctgtctcttgacttttgagggacacaccaacagtgttctcaaagtcctctggctcccgcctccccaagtctcgaacaaccaaacggatgaggatgaggatgacgaagaggctgcaacagcacgcaaaaacgccatccaggaccgtccccttatcgcatccgccgccgcagacgggctggtcaagatctggtccccctacacaggcgagctagaaaccactctggacaaccacatcgaccgagtctgggcgcttgccagcccaaccccatccggctcacgcgcagacgtgaagccaacctcctccaagctcaacaccaccccctacgccattgcctccggttccgccgatgcaacagtgaccttctggactgataccacatcagccacctacacagccgctgtcaacgccagctctgctcgcgtcgaacaggaccaagagctgcagaactacatccgcgccggtgcctaccgcgaagccatcactctggccctgcaactcaaccacccgggtagactgctctcactcttcacctccgccatcgacgccgcagacgacccaaccctccctgccgaggaccgcgagcgtgctgcagccagtctgtccggtaacccgtccatcgacgaagtcctgcagaacttggaccctgctaatctgcgcaccctcctactccgtctccgggattggaacaccaacgcacgtacctcgcgcgtgtcacagcgtatcctgtatgctctgttccgctcttaccctgcgtctactttcgtggagcttgcgacccagtccgtccgcggaaaggagggtcgtgccgcggctggtatgaaggatatcctgcaggcgctggctgcgtacactgagaggcactaccgccgagttgaggagctggttgatgacagctacctggtggagtgggttctcggtgagatggatggtggtgttggacttggtggactgcgtgatttgactgtgggtgatgtcagtgacgaggaagaacatgagaaggacgttattatgttggaagcatagtttggctttagtcttttgccctgtttgtacattgaatttggggctttcgttcttggagtaccatgggtgggaaggataaaagccatctctttatagaattgaatagtgtatcatggaaagtatcctttggccaaagccatctacatgtattttgattgttcagggtatctctttttttggttctcatggtaaaataacgagatggagggaatatgtgagggaatatgcagacagaagcagcaatctgtcgtgtacaaaggcccgaatactcttcaaccctcctcgccaaaacatttgacctctaatcatcacgacgactccgacgagagtcgcgatcacgatcacggtctcggtcattccgagacgagtgccgtgagctgctgtatctctcatctcgagaccgatggctgcggtccctgtcccgctccctatctccatctctccttcgatcgtctctatcatcgtcacggtcgcgacgacgatcccggtcatagtctcgatcccgataggaccggtcgtcccgtctgcttctatcgtcatcgtcgtatctagaggaacgactagaagaatggcgaccactagaccgactgcggtcacgtcgcgaggacccagtcttccgacgagaacgttcctcctcgtcgtcgtagtcgcgtttgcggtattcccggtcacggtccttgtcccgaccgctcttctcaaggttgcgatcccgtcgctcgcgccagtcgtcttccttgggaggtttggacttggcctccttctgtaaagcagcgagttcctcttcggtaagatgctcgccggttttcttattccgcatcgtgataggcatgtacacaccctcagccttatcattttcctccccctgtttcctcgacgccttgcgcatagccgattttccccaagctccaagctcggcttcggctcccttgccgccggacgaatcctttgcgccaatgccaaggaggccaggtcgtcgttctgggacacgagggtttttcgccctctctgcagctgtggcactgctgtagttgcctcgtccgatagcttgaccatccttccaacccattcctcgtagcagggcggcgccgaattcctcaacgggaatagcgttgtaggcgtccaaattagcaggctcgggccgggatgccacatctgttcggaaagaccctaactcgctgtagtgaactggttcttcttcctttgtggcggactcgataacgaggtctgacctccgttccacgtctcccttggtttcgcgaatcagcgcttgcatggcaatctggtcgtcagtgaggggcttggtctcgacaggtttcgcatcaggcatggcctggtcttcgaccattgccgcgccgctatctcccttctctgcagattgctgcgcaaagctcaacccgtacgccatactgggcgtatctgtctctaccgtaggcactccggattgtgcttgtccgttcttttgcgcttcctgcatagcctgcacttcggcgggtagcaggttcttcttgcttttcttcacattgacgcccgcccggtcgcgccagttgttcttgctcgttacggggatgatcagtggcttatttgcgtcctccactgcctgtccatccgcagcaatggcggcacctgtgtgggtgtcgaacccagagatttcctcgtggaccggaggggcctcatcttcgtcggagtcatcggcgtaaccaagctggtgaggccgccgaggcagtgatcggccatttgctggggaatttgtgggacggccgcggtttgaggattggaggttgaaaccagtcttttttggaggaccattcgaaccggataaagatagagagttcggtttggacggcggttgcataccctcattatgatcgcgcgaagacatcgcgatgttatcttggtttgaaacaaatggagtgcttagtagggaagagagagctcgaggagcagttgatactcgagagctcgtgggcggtggcaaaattgaagcgcgcggctaaaccggcagattttgtatgttgttaaggcggtaagcaagtcggagatggataaatcatcataaaatacctcagtatgatatgtgccacgcaaatcacctttcctgcctcaatagacaaacaccaacacaaaggtccttgggttccactcattcgaagtaatcaaaggcgagtaggctatacttctacggagtaggcagccagataatccaggcagtgaagatcacaaagatgatctgggcctaatcgggattttgaaggtactcgtaattggattttccttttcatcgttaacatcacttctcggggattcaaatggagtaatgaactacatgcgagccagcaaaatggccgagagccggttacgtagtccggtcttgtatagtccatttgttccggaactgtttttagatatgtttctagatatccacggatctgttaggtagtagtagaatcttgaattctagtttttcatctctatctactattaggtggtagtattctaaaaatatgccgaccagacaagcataataagacgaaaagaagcataatccaagtggaccccgatgccccacagggcgtattcgttcaaaaactacccgattcggaatctagaaatagccctagagaactgcatcagatgtttataagtccctataaatcccacatcttcctcaggaagaaagaactacactcttcttggcatcaataatatggatattgtttttcaccccggcaaaaacgggactgatccctgggtagagttctacccctacacaccatctgccacggctgggtatgcctttatgggaatctttggggtttcaacccttgtccatatcgtgttgatgttccccttccgtgctgcctacttcatcccactggttctgggaggaatttgtaagaagatagtccccatccacaaaagaggaaacatcaacgctaacgatgaacgaccaggcgagacgttcggctactacggcagggcatggtcacaccagtctcgatttgacatcaagtcatggtccttacaggagatgctcattctatgtgcaccgcctcttgtggcagccaccgtctacatggtcctcggccgcattatccgctccttcggcgctgaacatctttcaagcatgcgccccaaatggctcacctttgtcttcgttatgaacgatgttctctgcttctgtacacaattgggaggtgcaggtgtccaggttaccggggacgagaaggtgatgaaaattggcaagaaggtcgttttggctggcttgatcttctccttggttgtctttgcctggtttattctgattgcggccaaatttcatcgacgtctccagcaaagtcccacacctcttctcaatcagaatcccgatctgccctggcagcgatacatgtgggcaatctacatttcttgcttggctttgatggtgcgcaatctggtgcggactattcagttcggagccggtcagaaaaccgatgtcaacaccaaggaggtctatatctatgtttttgacgcctttttaatgttctttacgatgttggtattgaccatttaccatccgggtcggcttattaagaaggctcgtcgcttgaccaagactgattttacgggagaacgaaattctgcgcatgggctgttgagtgaatgcgagatgggcgagcgcatgccgaacaagtgattgatgagggttgaacaagttatatagccagaatagagtccatggtaccttcctcatgtactaagccgtttagggaaaccttcttcctcccgaggtcttcttcttcttcttctcctggcatctctaccctcttctctcttcacaacactctccactagtctatctttcttgaacttctactttttactttctctctataatccctactgctcgaaattatccacacaaatacacacactttctctcacactcgctcactccatcgctttcaagactatccattctcccaacatgcctgtcaccctcaccacggccaaacatccaccccgtgggtggcgactccggaaggtagccgacatcgaagacctcttcagacaatcctgcccagaagggcgtcgtgatagtaagaggttgattgggaactcatttgctaaagacttcttcgacacatctcacgtctccgcatccgaaaatggctttgtctgggccgtgttccacgcctatagccatcaccacaaccttgtgctgcggcccgaagatgtatggttcaccattctatcacagctcagtttcttcgttatagcacattccgaggaactgcgacatctattcgtctcgcataaagatagaaaacacctaagtattatctcaaatgagaccttggacactgtggactttggtgaactggcattagaaatgaccgagcttatggaaaagcatgtggtggatccggaactgcggagttggatcatgccggccttcagcaccacgactgcatccgacgaagcggtagcagctatcttgatgatgggctctatgcaaaagtatttcacataccaattcactttacggtgtgggattccgtctgtcactttgctcggcgaacgtgaggactgggcacttatggtaacgaagattgctcgactagctcagctaggggacgagcctgctcgatttgctcaacttcttcggccggtgcttaacaacttcgctgcttccttcgacaaccccgaagcacccgatgtactgagtttctggagcaaatgtgcagacagaagaggtggcggaagcggaccaacttacctgactggctggatatcggttttctgtttctggggagaggatgggaagttgctatacccagaacggattcttccaatatgctcgcgaggctttcaggaacgggagacggagttcgaccttgatcaggccttgtcacgctgtatagacacagagaaagtccctctaggctacgtctccgtgccggttatagttgacaatcttgggcacgtatttgacactgtgatggtggctggcatgatcggcatacaggccattcccactagggaggccgggcttggttcgattcagccagtgtcggggtggttcatgtatgaaaagaagaaacgagcgtgtgccaaaacgcacaatccagttgacaaaccacctagggtattggattggtcgttggtcagacaaggcaagtgaagcaattgggtcattcggttactttcgtttcaatttcgcttttgttttgaatattggcattgcaatgttcgggaattcccttggtagctaatcagcagggtcgtttcaaatctcaatattgagagtcgctggaaagacaaatacaacaaacctttgttttatgtctattatcgcttgaacagaagataattaaagggaaaggccggagagctaccaaagagggacattacagagctgataatatgtgtatcatttcatggggctaatggtagctaccgaagaacagttggcctggtgactacataacatgcgtgtgcatggcgtagcttgttcgaatttggtccttggtgttgctgcttttcctctgaaccgacagtcgtaggacatgtgttgttctttcatatatcgaaaacatagagatcatccataccagcgacacagttgatacatcttcgacggctacacaagaatcccattgggcgaaaagaaaaagaaaagaaaaagaaaagaaaagaaaagaaaaacttcaaactaatcatacaattcatatcaattcctagagtaatccgaccgccccagtttcgcctattcccaatgatacaagcccaaacccagaattcagagcagcactggtgtaaaaagagccagtgcacatcaagttcaaataaatgatgaacatcttttcaacgggccaaaacagataaaaaaaacacgcatgcggtagaggtcaacaaataggggtaggggtaggtgtaagtgacggtgtcggtgacggtgtagcgcgagaatccgaatcaacggtgaaggacaaagtgtagagaaaaataaatcagcgtaagggttggtgtaagtatttacagacgaaggtaaagtggggagagaaaatagatccgcaaaagtattgtaggggaggagaggaacaagttgagaaatctcctagctggttgccgtctgggcagccggagcgtgcgggctcttgctggaaccttgaacggcgccagcctgggcactgccactgcgctggttttgaggagtggcgctgcgactgggcagaggtgcagcaccgttcatggcgggtgagctagtcgggccaacgcggttttgttgaccgggctggggaacccgcatcatcggggagaacccttggttttgaggcacctgcattccagaaccaccgttcggagcctggaagttagcctcatgggggacttggtagttggcctggacagcattggcattgatgctacctgcagcggcattcatcgctgcttgttgggacaagcgctgctgttgctgctgctgatactggttgagtcggtccgtggccagcttggtcacttgctcagggggcatattagggttcgtacgttgaatctggctttggagagtgctgatttggggcacaacgccgctcgaaagagggttgggctgacccatacgaggcgacggggttgagacgccttgtggtgtaccaccgtggaacgatggactctgcattcccccttggttctggagggcagccatcatagcagggttattaggtgtaccgttaacatttgacatgttcatgttcggcgatccctgagacccaaattgtgggttgtggaattgctggccctgctgagggtgctgctgctgttgccgagactggagaagacgctgctgctcttgcaatcgattggcttctcggatgacgcgcgtgttatcaggagaggcttgcattggcaggcctggtcgtgcccctggcgtttgctgcagttgagcttgcggcatcatcttcatggccattccattgggcatctgaccattgggctgtgcaccattaggcatgttctgcattgggatagggcgggcttgattgacaccagcactaggaggaatgccgtttgtcattccgttcggagttccacctggtagactagggttggaagtggggggcatggtgttgttacgccccggcgcattcatcatttgctgctggttaggtacttggccggaacgctgcgctgcgagactagcctatataggggataagccacagtgctttcaggtaggaacgttaacaaccactcactctttgctgcgcaatcatttgctggcggtactgttcctgcctttcctgcagcttcatttctctgtcgtacttcagccggctgaactcagccggtgacgagatcggaggcttgggctggttagcctcattggctttgcgcaatgaagcaaggtgggaagctaagagatgaaatgtcagtagagtccttgccatgatgttacgtgcttctattccagacataccatgctgctgtttctgaagcatagtttcccgctttttggccagctttcgcatggcatcaagcaaagcaagatgcttcgaagatcgtctccggtcaacccgaagaggctgagtagtcctccggcggacgggcggctgaggctgagcgttggcgccttgctgctgctgctgttgttgctgctgttgctgggcagcctgttgctgagccaacacagtgcgctgggcagtctcaagcctctggtggtaagctcggaagtattgggttttggacatatctgcaggaagaccttcaagccctacccatcgctcgaaacattcccacggagtgcgtctctcggcgccagaggtgaagagtgatggtggggtaaggcagctggaaattagagaccagttgtaggagtactccttgaccaagcgtcggagttcatcatcctcagcgaaagtccattgcgaggacgaacgtgattcaaagaaaccaacagatggcatggggtgttcagtcggaggccggaattgatggccagggtgaatccgatcacggatgggcttgttctctggtcggaacagcgcaacgtttgtctgctcgggtgccaattcggtgatccgattatccgaatcattgccgtactgggagtagtcatatcggctccgcttacgaggatgatcgtcatcgtggaaggtaatcttcgccgatgcaaatttggacactggcagtagttccgtcttccaaactgtgtcaggggagactttgaatgccggtgcgttcgtgccaggggcgatctggagtggtccgtatatcggcaattcgtctaacagcttttccgcggcaggggtcatgtcaatcgagaagttgaactcatccgagcccaaggagaagatagcagcgggggcgactgcgtcatgaatgtcgtgtcgaggctcatcattgaacccatcactgactgattcttcctcggcggatggcatgagatctggagtgggatgagaaacaccaaacacttcatcgccaacgtcgtcggagggtggactgagaaccgccttagaggagtccttttctgtcacggttgccgttggaatctttgcttggacacgaagtaaggtccgatgttccacgtcgctgttgacatattctgcgcaccaatcggcacaactctttgcagcagcgatcttccactttctctcctcccggaagtcagttcgcatccacttcatgtgatctaaaacaacgtcccaatgtgtgccctggcggggaggttcaacagagcgttttaattgccgcagtggccatcggtttgcattttgaagagcatagattcgccggagggtacggcaatccatctgttcttggtattcaagcagatgattactagtactcaaggtcttatgcgcggatgccagcagggtattgaggtttgttccccggggaggagcgtacgctctgttcaagaataatgtgaaaagatagtcttgctcctcgttcagcttggcaactgcatccatatctcgatgcgtcagatccgtagagtcggccttctcctgctgagctggctgcttgggaaacacgacagtcgagagtcggcttctctccttctcccgctccttgcggtccttgaagcgcatcctcgcgacagaatccggagagccttgatcagacggggtaactgggtggctcctatcatgagtgacactcttaggggtttccccaaggatctcggaaacagatttgtgccggatggctcctgatgatacccgagtagtcatgcgctctggttgcgccgagccaggttgagttggggggatagaaagctttttggccgtgggagtctcgacagttgaatctacagcgacttcggcttgtgcggttggtgacaacgagtcttgcacagtcgtctgtggttcttgtggtgctttcgcttcagaaggaacgggctcaggttcctggtcaacgtccatgcgatctgtatcgaccccggtgtccacactctccacaatcacctctttcaacgaaggtatgtcggcgaccacatcattcacaggtttatccggtttcgactgagcttcttcgagacgcaattgctcgtctggggttaagggaaccaagctcgggcgagggtgggcagatcggtcatgcttatgttttgggcgatcaattgccccaacctcctcagtcacttcttctgcggggcttgtgtcgggtgatgcggcaactgggacgggtgtattattattgtaagggtcaatggaggaggcaggtgatggtggttgttcgtgttgagatggtcccagtgtaacagagggtcgtgcttcgtgtttctttcgaagagagtcagagggaatctccagtgatggaaccccagtcgcggttggcttcgacacgcggggggagatcgttgcgtcattgtcgtgggcactgagcgacgtttctgctaccggtacactagctttctgttcggcgcgcgatgagtcgagtgactgcacagcgatcggtggcacgtcgagatcccttggcagcctagggctggtagctggcactgatggccggcgtgttccggttgtatccacgggggtaggtgggagatgagatgtcgcggtctgaggttggtctagaatgggcgttccgtgctgttgaggctcggtcgcatgcggagctccgccatcaacggttgagggtgaagtgatcccagcgacagctttggtgctggtggtggcagcggttgtcggggggattgcatttcgacttggtgagcgcgcgcgcgcatgggttggcggcggaagagtagcttcattaaagtaacgacctctagacagggaatcagcattgggaaattataaacaaaaataaataaatgcaaaatggattccactggcagagagtcaaggcgattggacttacttggagagatcattggcgtcgaggaaggcctgttctttctggtggtaatgagcgtcctcggtcgcgccaaacccgaccgtggctagatacaatgcgctgagcttgcgctttctgcgcgacaaacagtttctaaccaccaaattagcgacaaattcatcatttctaggcttcccaatcgaattcccgccgtcgaaaaaattaatacttacgcgatctcatcgtttttagatcgtaggagctcgtcacggagcatggagtctagcttcggaacgcagcatccgattaacgcgggaacaaggggaactgatcgagcgaggtcatccagatggaaaaaatcgctcgaaaaagatgaaaaagatgggtggagggtaggaggcgatgaaaagcacctggagcaggatcttttcgaagggggtgaaaatgaggttacagggcggtatgaaaaatgtggaagaacgggaaagatgttggtttaggtacaaccagttactcgctccctctataaaaaatacacggcttggccaggtacctggtacttctgaaaaattccctttgatgatggagggaaaaatagaacgtgatatcaacttggggatacaagaatgatgtctactttaatgagctataatatggttgtcaaagacatatgtgttttttagaaggctgctctcatcaactggtaacgcactgtattattgttctgacattcaattctccgcttgcgtatgtgaggcctcaggcataaaatatagtaaacacctaatatttatggcaataaggcatttatcacaaggcatctatttcctatcaaggcggccaataaaccgccggcagaaaatcaagaaaaaaagtagtccgctctccagatcaagctttcacatctacgatagaacaaactacgatcattatttgagcaatcatggtgaaacgcaagagaactgacacccccaaggaggacaagacggctggtactcctcccaaggctaccaaatccgcccctactcctccagagactcccgatgcagctttcactatccaagttgttacaggctcttatgagcgggtgctccatggcttcaccgttggtatccctgcctccagcctgaaaacaaaggctgaaggtgactctccggccatccaatgcatggatactttcctattcgaagcccatggatctgcaattcgttgtctagcattgtcaccactgcctaaacccaccgaccctgtcgatgcccaaaaggtgatgctggccagtggtagtacagatgagcgcatcaacttgtattcgatctccgccgcaccccctgccgtgaatgaagaatatccgtccgtgccgaccttcgccggaaacaagatcctcgaaaaccccagaaaccgtgagctaggatcattgttgcaccacactgccagtattacctcgttgagtttcccttcgcggacaaagttactcgcagccggagaggacaacacaatctcggtttccaagacccgcgactggaccgtcgtatccactatcaaagcaccaaacccaaaaatccaaggacggccaagcggtgatacggcgcctcccggagctgctccatctggagtgaaccactttgcagtgcaccctagtatgaagctgatgctgagtattggacgaggagagagatgcatgagattgtggaatctcgtgaccggcagaaaggctggtgtgttgaacttcaccagggaagtcctacaaggtgtcaaggagtcgagatggagcacaggcgaaggtcggcgcattgtatgggactctgagggagaggaattcgccgttgcattcgaatggggtgcagttgtgttcggaatcgtaagttatctggatggtataccattgatcaaatttctgactattagcacaggactcgattcccaggtgcagacttatccctagcccgcggagcaaacttcaccagatgaagtatgtgtctttgcctttgaagggtggtgaaaaggaagatttcttggctgtctctacggaggatggccgagtgatcttctattcgaccaaagaactgaaaaatgcggaggatgataccgaatgctcaattcctcatgctacgcctgttgctcaggttggtggaaagcaagctgggttccctggccgcatcaaggacttcgagatcctcactcttgagggtcaagcaaaggaattccgcaacgacttcttggtcgtcaccgccaacagtgacggagttgtccgtgtttggaaggttggtggaaaagaagtttccgcagcaaagcaagaaaagaaggatacgactcagattgggaagctcttgacgacaaatgaaactggtaaccgcatcacatgcatggctgccttcgtcatgttgcctgcggaggacccgtctacactgatagactccgaagacgactccgaagatgaagtggagtcctcgagtgatagtgacgatgagtaacctcattattctcaactgttataccctttataccgtcaaatagatccccagtggcaaacaatgtatcatgagtatgaaaagaacctgggattattgccctagaaaataattatgactatgttttctaccatttttcttttcaatatcagtattcaactcacctaagaatcatttaacgtatgttactcctgtcgctgctatataaacctggtgtggcgcacttcatggtgtagttgtcaaggattttcttagataaagatgaatgagtcacccacaataaaccaaccttggaagagacagcactaaacctgtatatataatgcctgaaacaaacgcccaagtgaattatattatctagtatacttactaaaagtgttataacgtagtaggaaacgtagagttgccatccagacaccgcccggctctccactacacacaatcccccacctacattctttcattatcatatcgcgggaagcaattttcacccgaccttctaccatcccacaagcttcgtttagccacttgcgtttttattcaacgctgctgttaatcgcgagttgatttcctattccatttcgcaattatggcatccaacggcgacttctctgacgagggatcccagcccggctcacctttactcgatgcccacaatgcccgcggagaggtcgaggaccaggagccccttgagcaggaagagaaacctctcaagtctgctatgaagaagtccgagcctgctcctcaaccgaagcgtccagaactccccgagcagcccaacccggacacgctcgatctgtcaaaattgacgcctctttcacctgagatcattgcccggcaagctactcagaacatcggtatgtgaccgttggtttttgaaagcttctgcgttcagaaacacacttcattcattaggtccaattttgctatataacaaatttactgacgtgattatcaggcaccatcggacatgtcgctcagttagacaccttcccttgcctttttcttcctacatgcatactaatacaatcttagcggcaaatccaccgttgtcaaggcgatctccgaggttcaaaccgtccgcttcaagaacgagcttgagcgcaacattaccattaagcttggttatgccaatgcgaaaatctacaagtgtgacagccccgaatgccctcggcccacatgttacaagagtttcaagagtgagaaggagatcgaccctccctgtgagcgtgaaggatgtacaggccgttaccggttgctggtaagtactcctgctccttcccctctgaagtccaagtcagagcctttcctcaagtggacctaatctaacctctgatacagcgccacctcaggtaccatcaatccccaatctacccccaaactggagttccatccttgattcattgggtataagctaacctttaatctaaaaacaaaaagtttcgttgactgccctggtatgtttgctagatcttctctgtccagagttagaacactgctaatcttcaatcataggtcacgatattctggttagtacttattctcttgtgtatcttgggaaactcggtttctctttgggtgtcgattctaatcagctttgcgcagatgagcaccatgctttcaggagccgcggtcatggtaggtttcattctccaccactgcaacaattaggatttcgagggatttgtgataagctaacatcgtttttctaggatgctgctctcctcttgatcgccggaaacgaaacatgcccccaaccccagacctcggagcacttggccgccattgaaatcatgaaactcaaccacatcgtcattctccaaaataagggtaaaaccatggttttcttgtcaaactgccgatgaaacgaagcgctgacgtttaaaaataaaacagttgacctcatgcgaagtgataatgcccttgagcattaccagtctatcctcaagttcatccgcggtaccgttgctgatggatcgccggtcatccctatttccgcacagctgaagtacaacattgacgctgtcaatgaggcccttgtccagaccatccctatcccccttcgcaacttcgaggctacgcctcacatgatgatcattcgttcgttcgatgtcaacaagcccggtgccgagatcgatgagctcaagggtggtgttgccggtggttccatccttaccggtgttgtaaagctgaacgatgagatcgagatccgccccggtctcgtcaccaaggatgagcagggcaagatccagtgccgtcccattttctctcgcattgtgtctctcttcgctgagcacaatgacctcaagtttgccgttcccggtggtttgatcggtgtcggtacccgcgtcgaccccacgctttgccgtgccgatcgtctcgttggtttcgttctcggtcaccgtggccgtctccccgctatctacactgagattgaggtcaactacttcctgctccgccgtcttctgggtgtcaagaccgccgatggcaagcaagccaaggttgccaagcttgctaagaacgaagtcctgatggttaacatcggttccactgctactggtgccaaggtcctcggtgtcaaggccgatgccgctaagctcagcttgaccagccccgcctgtacggaagttggcgagaagattgccatcagtcgccgaatcgagaagcactggcgtctgattggatgggccaacattgttgcgtaagtctacgggtttggtattacttctagtgacaaatgctgactgtttcgattctcagtggtaacaccctcgagcccgtgcagcagtaaagcaatcctttcaacgatttcccagttcgaaatggggagcttggggaatgaggtctgtcatgtcggggaatttgatttgcacataacacttgctacctatatccccggacaacgacctcaccccaccgaccctcgaacacgagtcttgcgatctatgattgcaaaaaagttttatggtcataagtcataacgaatcagagaattaaagacgtgatttaactgattccccggctgaatagagaagatggaggagtcatgcaacgctgtattgtcgccaccttgatcggtttacctgcttcatgcatgtcagcgaccactttatctggtctgcgactgtgtgctacggtttggtctgagggacggacgacgaacggggatgctggtgaagtcggcgaataagatatgtgctttttatttccatcgtacgagggagttgttttcaagaggtttcctgttcattgctcggttttttgtctgcatcatcggatcttatgtagataggcctataggtacaggtctgggtttaaaatgcagggaagttaggaccagcacagctttaagagcttctgcatgtttattctatttacagatgggcttttcgtctgatgggaatacaaaaacattcgcaaatgagatcgatgctcccactagatcgtccgcatgtcggatgtatatattctacctaggtactacatgtatgactaccaccactcgatatttcctcacaacgtaatgaccatgcacgcttgaccaccaggtattgtaacatacagggaatcacaagctatactaacattcaaatgatgacatctacaatattcgactattgtgctgatcgaccgttgtagcagcccttcatttacctttaatgttggcagagtaaaattcaatatagtcatattaactcctcatctcgcaccccagatattcggtttagaatgaacaagattctcgtcaattaataggcccaattcctgagatggacgttgcgttaggcccccggggccatgggatgatcctgacatgcaggagatctgactaaggcggccgataataacaaagtagcatcttctgccttgaacaacgccctctttcttcggctagttgcgcgttttcaatcatgtatatcctcgaggtaagttgttttgattgagatatcatcatgtttccacggtgaatgtgctttctatcgtggacatgtcgctaatgactgtcttcctgcagcaattggcgcgcttgctcgatcgcccgttcttcccatggaagaacgtgcttgtgggcttttcactgggccagttcgtccttgaaggtttcctgtcacttcgccagtacaagtttttgcaacggacgaagcctcccaaggttctcgaaggggaggttacccagaaggtctttgaccagagtcaggtatgaacccgatcacagagcattatgccatatacagaggctcattggaatatcatcacaggcatacggtcgcgcaaaggccaagttcagcttcgtttccggtctttacggtcaagtccaaaaccttgcattcatctacggtgatgttctccctaagctctggggcctcagcggtctgctgctggctcggtaccttcctggtcggttccaaggcgaaatctgtcaaacattggtattcttcttcggtttcaacattttaagcaccatcctctcgctgcccgtctcctactacaacacgtttgtgctcgaggagaagttcggtttcaacaagcagacggttaagctctggattacggatatgctcaagggtcagatgcttggaattgtcttgggaactcccattatcagtgccattcttaaaattatccagaagtttgacagctcgttctactactacctctggctcttcggtgtcttcctccaggtcttcgccattactatctacccgattgcgattctgcctctgttcaacaagctctcgcctcttcagcccggtcaactcaagaccggtgtcgaaaacttggccaagagactcaacttccctctctccgagctgcacgttattgacggcagcaagcgcagtgcccacagtaatgcctacttctacggtctgccatggaagaagcacattgtcatctacgatactctgattgagaagaccgagcctgaggaggttgttgctgtgctgggccatgagcttggccactggagcctcagccacaccaccaagctgttcggcattgcccaggtacgaactttctcagttgctgttttgccgaattatcactaactatgcaatccaggcccacatgttctacatcttcgctctcttctccgtctttgtcaacaacaagtcactgtaccagtccttcggattcatcaacgaacagcctatcatgattggtttcttgctcttctccgatgccctggctcctatggatgctgtcgtgaagcttctcatgaacatcctcagccggaagttcgaatttgaggccggtatgctccgttcaacctgtcacatatactctcggttttactaacagtacccccccagatgcatttgcccagaaccttggttactccgacaagcttgcatcctccctcctgaagctccagatccagaacctgagcactatggacgccgatccgatttatgctagctaccactactcccaccccatcctcaccgagcgtctcgccgcgcttggctggaagggtggcaaggtcaccagcaacaaggaggaagacagtgagaagcctgtcaaggccgcggaccgcgagctataaacggggtgcgtgttattggtgactttaatatgatatggacgtgatttcttttgtgcctgtgatatcttggaatatcaatctcgagaagcaaaaagcgaggcttggaaatgttccattatgtattgattggattgtagcaatctgtctaatctctaaatgacactttttgtccagacatgaaatgcgagtacttttttgtacgtccaagacctaacccagcccacaggaatagagcaatagaacgaatgaaagacaagagactccgacccaatgcagcaacgcccacaaccaaatatatacccacacactcaatcggattcctcagccttcgcctgggccttactcttcttctccgccaaccgtctctccttcttcttccgcttgcgctcctccttatcaataccggcctcctgatccgcgaaagcctcagcctcagtgccaaactcagcgtcatccatgacaagatcattgctatcatccagttgttcctggttgttggtttgcggaatacccgccgcaacatccaaatactcttctccggggttctgcttcgcgacggtcagatcgcgaccgaggagctcgccggccagacccgcttgcacacgcttcaggttatggaggatcaggttcggcgctgcagcggtcgtccgtgagacggggccatgctcgctgatgctggcgttgggttgcaaggacgggtctgtcgcggcgcggtccaggtaggcagctaggaattcttgcgcggcggactggctgatggtctgtgtgttttgcactgtgactggggggagggcctggggaccttgggttgccattttggtgggattggtattcttcgccgggtttgatgggcggtttttgaggttaaaggggcggtggtgccgattatggagtggtttggcccggtggtgggattgacaaagccgggagtagagtttctctcgaggtcagggtcactttgcgagcagtatggagagttgcacgggcgacgttggacatttcgcatctcgagatcaaaaaagttcggtgacgctagtcccgatcgggtaggtcttcttaacgggatgcgctgcaggtatagttgatatttattgacagataaacgaacgtagttatgtagtagttatagaattataagtagatcgtgcactaaacattgtccaattgcgtattctatatatcctaagtaattaactgtacatccttgtagacatacatctctaggcgggtccgtgccagcggctccgcgcttaattttctgtcttccgacgccgcgtcttgtccaccaggcctcacttgatctccaactccgaaatctcaccccaccgtcaatcgccctcggacaaagccagagccctgaaaatgttttgcctccgcgccaaggccgtgccctcagccttccgggccaccacatcggccatgcgaaccccgatgaacaggtacgcaaagcacccaacctttccaacctctataccagacagctaacacttctactccaccttgcaacagattcgccaaaatcccgcaacaaccaagcacaccttccacaatgctctcatcccgattcttctcctccctcctctccacgccaacccgcttccaagcctcgcgaacactcggcagccgcctctcctcgccaaccacaaccgcaaccgcaaccgcaaccgccttctcacccctgtcatcactcctctcccagaaggcaccctcgcagactcgatcattctccgcaagtgcctccctaggcgtgcgccgtgtgacattccgtccgtcacgacgggtccaaaagcgccgccatggatacctggcacgcaagagggacagaaatggacgtaagactcttatccggaggactcttaagggccggaaggagttgagttggtgatttattcgtttgtgtgtccgaccttacaatccttccggggttgttgtggaagaggacgggatttataccacagaggactagggtgtcatggattgtggaatctataacggctcacggcgatggtgggaaggcagtagggggccaattactgatgcatccacttcttggaactattgaagtcttcaagattggatccgagttcagacaggacagttgctggcgggtcttgtctggcgtgtaccatatttacctctcccgaggatgtgtgtgactacatttcatatagtgcgagtttttcagctttctttgtttcagtcgagatcccggcgtttactgggttgcagctttgcagcaagtaaaagagtagattcatcactgtctaggttgtgtagagtctcttgacaccacaattctgtctatgtgatctacctagctacccgtgtatagatcgttcatcaaacatatcactcgcgttcgtcttcaccaccctccgatccagtctcggagtcctcatcatcatcgtcatcgtcatcgtcctcatcttcttcctcgtcgccaaccttcagaccatagtcgtcctcgaattccttaagaggctgaactgtgggagtgaagccggaagtttcgaagccctgcttgatggtctgttcgcaataaaagttagcaatacatacatctatctgtcaattgaataccggggaacaactcacctcttccaacacagtcgcgcaggtgacaaccatgtttgcagtcttcggatcaaacaacggcaagataatcttacgcagagcacccttgatctgatcggtggtgatggcgcggacgttcttgagcatcttctccttatagtcgctgggcaagttgcgcacgacttggcggatgaaactgccctgggcagcattggcggctgtcatctgctcattggcgtagttgaccacgatgctgctgatagcaccctccaacatcaaaggatcgaaaggcgtagcgccggacagatagttctcaacaatctgcttgctagactcgaatgccttgtgggcgttcggggaccggtacacatcgaagttgacaaagccagtgtcgatgttgtagctgaaattggtgccgtatgccagaccagtgccgcggacagcaacccagaggggaccctcgacggcgttcatgtacgaaatcgcgaccagcagggcgggcaggtccggggaatcgtacgagtccagaccacgggcggtagcgtacgcgaaagacgagtcgacagtcggcatggggacaatgtaagacttgccgccaatgttcttgccggcctcgctcagccgggaccgccggtcagtgataggaagcaactcagtgctggtgccgagggtctcagcgaagggtttccaggccgagacagggttctggagtttctcgagatcggcaataacaatgacgcgcacgttgtcgggccggaagagcgagctgcggatctcctccatgcggcttacgatttcctcgggcttctcggcgagcagacgcttgacgcgcttgaggtagcgagccttcaccaaagtagaacgagcacgggtgatcgactcctccgcgtagtgaaccatcacatgtgcagcagcaagcatgtcgtcaccactgcgcttggagtcgggcacgtcggccaagagacgggagttgatagcccggagtctctccacgtcaaagacggacttccagcacagctcctgtagccaggcgacggcgttcgcatacttctccaactcgacctggaaggagatacggagcatctccgagtttccgagaccgcgagcggtctccatcgagtatccgacggtgtctctctctaattccaccacgacctgttcaaagtccattaccttgccatcacgctgcaccggaatgttgaaaaacgcctcggtgtagatggacagcaatggacgcaactgaacgggcacagtatcagctgagatgagaactgaaagctggacaaagctactagggatgtgctcgaagtggatgaaaagagactggtcagacttgtcggcatcaacaatggattggaccttgttgttggggcgtccagccttcagggcagcacctgaacgagccgtggtggtctccatgaagtggattgactcggttccggggatagtgaactcttccagcaattcctgtggaatctccttgtcgttctctgccatggccttttcgagtttttcggcaagctccttcaggcccttctcgccgagacgctccttctgcgcagcggcccggtcctcctcgtcctttttcagtgtggcggacatcttctgggatgggatacccaagatggtgacatgggccgcatccgagatccatttcttgatgaaagagcgccactggtcctcggaccaggtctcaaggacatcatattccctcagagttgcaacatccatcaaagtcgagccatcacgctttccgaacaggaagtcagagataacgtactctgcgaatgaagaggcagaagactcagtcgagaacttccaggttcggcgctgccgggcgatgcactctttcaagtatttcagatctaattccttggccatcgcatcttggaggatctcaaagaatctcttctcaacgctctccagcttctctgtttccacgctggtcaatgtgaaacgaacctccatgctaggatgatcctcagttgcatagtaaacggcactggcgagctgttctttctcaacaatgatgttctctagcagggctgcagatgaaccggccaggtacagaagggacacattaagagccccggctataatactgtcagtatcttatttcaggttttcgtgcttgggatcttacataggacggggtcagtgcagtcaggtcccatgaatcgaatttcaatttcaccaaatgattcatcctcttcggggaactcaaccttctgaataacggacttctccaagtagggagcctgcttggaatccacccaaggtctcttgaatggtgcatccgggctaggaatgacatccaagatagtgtcttcgaacttatccaagatctccagcatgttgtcttggtcgacttctccagtgaggatcaggcacaggtttttgggctgatacatctcacggtggaactcgcgaattcgttccgcaggtaggacacgaagctgttccatcatacctcctgtctcataacggaagcccacgccaggcgggtaggtcaaccgccgggctgccaggtcgatcagctcagcggcattgttctgcacaccctgcatttcggagtacacgacaccggcatcatttccagagccatcgacgtggtgaacctcagtgtagcagccttcgtcagtcagagtaggagcaatcacatgctccaggtagactggcaggatacgagcaaagccttcccagcctgcggtatccagcgtgtaggcagtgtgatcagttgccgtccaggcattggtgctggagtacacgcgtgtagccagcttatccaggaagcccttgtagcggtaattgcgggaacccatgaagcacaagtgctccagagtatgaggagcacccgaatcatcgtggatctcggtggcaagcacaaagtaaccgttcacttttggacccggctggtcgataacgaccactctcatgccggtgcgctgtgattcatactgagtgaactcactcggcgagtaatcaggcttgaactgctggagcagtttgaagtgacttttctgcaccgagggcgacatattgatcaatgggacagacccagtgaagatatttcgccgtaagtttgagagtctggttgtcttcgttagtaattcgtgtccattaattgagaattgatacagtcgtgagcacatcaacacattcacaatgaggaatagtctgataacaagtacaacaaccacaactcggatgagagaagaatatccactccgagcttacgtcaaatagaatgcgaacaaaagcagcaacaagcaaatcctttccaaatcatgtcctttcaggacatatccggcagacctgcgacatatcgccaaggataagtggcataagtggggtggcgagcagaaatttggggatagcaggttgatacacttgatacacccctaggcaataagaactaagaacgcaattcatatgggcttaccgaaagcacgtacttcgactcaggaggaatatccgagacacggtgagtctgaaatgacaaatgtcttcgaaagtgtgttggtcccggagttttccaagtttgggggagacctctccggttttccttacaaagcgggcaagtgaaagaatctatagaacaaagaaagaaatattagatctcaaattattttgcaaccagtcacattcaaaagaatatatatagtcttatcaaaattctagtaaaacttagagctctagcagctcaagcatacagcacatacaccacgtgggggcggtgacgcccaaaccttacgagtcacgggttattgacagctcaactctcctttacgtgtctatctccgaaggtccgaagctcttattccctgttggacaatccatttcggaaaaaaaaagttgaggatgacaggaaataccgaggagctgtgccaggcggtgctaggtttcgtcacccaaggcacgtatcccgaggagagtgtagttgctggtaagttcccggcagctgctctcgccagggaacttgagcttatatcgaaggcacgtgagcaggtagaggtacagaatctccaatgtctatctacatacgtcggtggtcactgactagctctgctttacttgattagaatgagattagctccttgagtcgcgagaacaccttcgatgccgacgactggattatccaagcgaaacaactccacgccgacatagaacgctcaagattgactgcgcgagaaatagtcgcgcagcatgagcataccgaacccctacaggcaaaggttgaagatgcgagggcaaaagtcgccttggttgagacggagattgccttcaatcaggccgtagcgggtaccctagaggaggtgcaccggttgtgccagcagctggaaactgggcgagctgcgctcagaagtggccagatcaccaccgccattgagcaattggagtctgtcgacgcagctgttggaaaagacgccttctttaccaatacaaatgtgatgggcatactctctgacgaagtgtcattgctgcggtctgagattgttgaggctcttcgttcccgctgggctgatcaattgaaagttgaccgaaaacaaggcgaattccatgtctccagcgcagacgcagatgcagattcacttcagagcactattacgtcgctgtcccgactggatatactcacatctgccattgagaaactacaaaaggatctcttgtctgcaatcgtaaatccgatcttgctacctcaccctgatggaaccagccatggtgtggtggtgacggagaccagcatccgcattgagccagaggcctcaaagacaaccgcactagagaccttggatcgcctttccagcgttctgggctacttgcgacaaaatttaccgtcattggtgtccgcaaccttctccgaatcgttcattgtgactatttcctcgaaagcaatctccgagtggctatcctctgctattcccaccgacctggctggcctcgccgagtttgagaacatcctgaaccatgtttcacagtttgccaagcagatagagtcttggggttggactggccaagaaggactcgtctcatgggtcaaccaagctccacgcctgtggttgactcggcgtagagtcgactcgctcgatagcgttcgcaaattccttgctgccagccaaggaacaacgaagcgggtcgaacgaattgaaaaggaaaaggtttctcgcgctgagggtgctctactggagaacgccggcaatgaggactgggacgcggactgggacgacgataatgaagatgagcccaagaaagaagaagcaacaaagcctgatggagaagaggaagatgtaagtgcgtggggtcttgatgacgaggacatcgaggagactcccgatcaggccaagccagagacagttgcttctacggacgaggatgacgctgatgatgcctggggctggggggatgaggatgaagatgaccataaagtcgatgataagccttcgcagccccagaacacagcagcggtaaatccaaccgacaagaaggatacggctggatttgtatcaccgaaagaggtcactctgaaggaagtcttcacgatcaccgatatccccgagtctgtccttgcggtcgtccagcagcaaatctccgattcaaaggatatcttgcagcctgcgtaagtcatgccttttttcgatcttaaagtcttttcttgccatcaaactaaccagagctcagccatgcccgttcccgcgttgcttcttctggtgctggtctccttgcactgccgacgctgatcttggccatgttcaaagctacatcatccacattctactcgctgaagcttacttcagggcagatgtacctttataatgatagtctgtaccttgctgatgaaatcagaaaactggttgaggaacatcaactctccagacttcagcccgatgttgaagctttggagaaatttggcaaacttgcgtatagcaaagagatgcagacacagcgcacgatcgtcacagatctgcttgacggagcccaaggatttggacaatgctctgaacagccattccaagcagactgtgagaattccgttagcgcgactgtcgaccgacttcgcgatgtttacaaggaatggcaacccatactgtcccattccgcgctgctccaatcagtcggatctctcttgtctactgtgatcaacaaggtggtcatcgacatcgaagatctaggtgatatctcggaggaccagtcacggcagctagtctccttctgtaaccaaatctcaaaattggaggacctcttcatgcccgagacaggtggcgatgccgaggcattgccagtcacagccatctacgttccgagctggctccgtttccaatatatgatcaatattctggagagctccctcgccgatatcaaatacctttggatcgaaggagagttgggcttggagttctctgctgaggaagtgattgacctgatcgaggccttgtttgcagagtctgattaccgtcgacgtgccatttcggagatccgaaaggcgcccagaggataaaacccatccacacaatagaaatacagttattcaccaggtataacttaaagctgcaggtgtattgcaatcaagtatgtagaccaagtggagacatctccgcgctctgcgcaagtgtgccgcacaggtcaccgtattttttcctcacccgtcgaaaatgcgacagccactaaaaaagattccatctacaacaacggcagcaatttgaagtatttcacaatgagtgaagatttggttactgctggtgcagcagaggctgtgcagagacaagtccgagtgcagctcatcagccaggaggaggatattgctctgcctgaaagcaccggcccaattcttgttcctactggtgagactcattgtcgatcaaaaatcataaatgatgatatcaagtactgacttttccttcgaaaaggacttcgacgatacgcgctatcgacattagtgaacaaccttctctcaagcgaaaagcccattccatttgagtttttgatcaatggaacttttttgcggacctcgattgatgaatatttggtcgacaatggtatctcctctgagacgacactcgagattgaatatgttcgagctttgatcccgcccctgcatatcgcctcattccagcacgatgactgggttagcgcgacagacgtcctttccacaacttcacctgctgcatcctgggcctcaggcgcgaccttcaccaagggccaggaaagaatcctatcaggaagttatgatggtcttcttcgcatctggaatatgtcgtctgagactattgcgacctctcctgccgccgcagatggtggccacaccgcctctatcagagccgccaaattcgtttccccgaaccagatcgcatcggcaggtctcgatcgcacggtccgattgtggaagtataccgagggcgaaggtggtttcactggaaaaatttctcctcagctagagctgtatggtcacaaggctggaattgagtcactagcggttcatgccaagtccaaccgtctgttgactggttctgcagacaacaacgttggattctggtcaaccaagaaggctgatgccccagcagcacctgagaacttgcttccttccagcaatgctcggaacacaaagcgccgcaagctgaacacatccgtcagcacacctcagcgtggtcctctggctcttctgtcagcccacacggcgcctgtctctgctgctatcttcgacgcgaaagatgctactgtcggttactcggcttcatgggatcactccctgcggacctgggatttggtcactggttctctggttgatactcgcaccacatcacactcactgctctcgctcgagcacctcccagaactcagcctcttggctgccggtactgccgcccgtcatatcactctgattgacccccgtgcatctgccacgactgtggctgctatgactctccgaggccacaccaacgctgttgtgagcttggcccgtgatccccacagcacatatggtctcatcagcggtagtcacgacggcacgtgcagaatttgggacatccggtctaccaagaccgacaaggaaggtgttgttggtgagagtgtttactcgattacccggaagagcctcgaggaggagggtaagtcggatagcaagcgggttggcggtgaaggtgtcaaggtgttcagcgtgtgctgggacaagacggtgggcattgtcagtgcgggtgaggataagcggatccaaatcaaccgcggcgaaggcgtgctgtcttcgaaagcatgagtgcacatatgggcctggcgtttaacacttggttgagggcaaaagtttagacttacacatatttttttctccttactttccaacttcgcgtatatctttagctcgcaattggatatataccaaactgcaaactaatagtcgctacaactttgccgtaaacatatttggttttgaagcttccatttaacccaggtttatgtctagcctataatacatccacagaggggttccattcacatacaaactggcaaagaccgagtgccaggaatcaatacaacgccaaatccatgcctctcacgcaaaatagtgagacaatcccataaaagtaacaatcgaacgcgaaaccactaggcttatagtctccgctccatgcggttcaacttgacaggagttttgatctattgagatttcgttagccacaaattcgcttaatgtctctgagagacagcgcaagctgagatatcgcaaaggggaaaagggaaacccacttgtgtccgtgtccgctgtcccctcacaggcaagcccaacgcatggcgtcggccgcggtaagttccggtctctttcatgcgcttgatatcgttcagaacttctctgcgcagatcgttctcgattttcatctcagacagcacagccgtgaggtcgagaacctgtttgttggccagctcgccgacgcggcaggtcgggtggatgttgaagcgggacatgaggcgggcggagctgttgttgccaattccgaagaaggtctggagggacttctgttgtactcaatgaatgttagttggatatcgaggttgcgggcgcaatcgtgagggtcggcttgccttgagcaggttccgctcggggaagttgacaccaaggatgaaaacctaaagagttattagcggagttccttgggacgatatattccatctcgacagtggctctcataccatcttgaactatgttggctggctggtgtcctgacaattgtatgggccgtcacttgttgctctcgttgaaccccgggagaaatcctccgtcaacgtgaaacgtttttccgtaattcgatgcctgaatttcccggcagtaacacatctgttctccgcacgccattgcaagctggccttctttccccccaattgcttcatcttcccctttcactgtatcctactagagcagtggcaattagcaaacatgtatttcaggaatctatttttgtcccttttcttcgtcttcgccgtcggctttgcgctggttcaggccgaagagtccaagggacctcgcggccctaagattacctccaaggtgattgacattgatgttctggccccgtctatatgcaggcagttctgatttttggtgacaggtctacttcgatattcaacatggagatgagtccctcggtcgcattgtgatgggcttgtacggcaagaccgtccctgaggttcgtagaactatatccatttggaattagcaattgagactcgttgctgacattattactctggatagaccgctgagaacttccggtatgatgaaattgctatgtcaaggcctcgaatgtctatcctgcatatgctaacccacttctagcgctctggctactggcgagaagggctttggttaccaggactctaccttccaccgtgttatcaaggatttcatgatccagggtggtgacttcaccaagggcgatggttcgtgagcttccgagcaggttagattttataatactaagtatgtacaggcaccggcggaaagtcgatctacggcaacaagttcaaggatgagaacttcaagctgcgtcacaccaagaagggcctgctgagtaggcatctccgctcctttgattcaatctcacagggatctgaccattcttaggcatggccaacgctggcaaggataccaacggctctcagttcttcatcaccaccgctatcacctcgttcgtatcccttgtaatgatttccttggtgcaataactgacttgaaaccacacagttggcttgatggccgccacgtcgtcttcggagaggtcctcgagggctacgaaattgtcgacaagatccagaacgttcccaagggacccggcgacaagcccaggctggcggttaagatcgtgaagagcggtgagctcgagctcgagcccgagactgagaccgaggacaaaggtagccgcgatgagctctagacaggtgactgtctgcgcgatgtttcctctgctactggtcggaagtggctgatgatgttggatgtcttaagaactcaaccaagagccgggtgtcaccgacaaagcccccgatgcccccgaggccgccgtgccatcttactccctgcagccggccatgattttcttcgttctggtcgccgttgtgggtatctggattgcccgtcggcgaggccagcagcaacagcaacaacaagagaaagaacaatatgttgcataagagaggatgttagatcaattatacgttattttggaccctcggcccgcccgcccctaaaaccctggatttcaatgcccggtgactctcatcatcataaattgatagatcatctatggatgtttccttgtggtcacgtaggtggtgatatacttccaagtacttcgtccagtcaaatcactcgcctcctgtcttagtcagacatggatctccagaccgcccgcgagcagcaaatggcgggtagaaatttcttcagtggcggtaagtacctggttggtacttctggtaagcgggttttcacactataaaattaggttcttctgttgtacctccaatagccacacagcgccccaactctccaacttttgttgcctccttcccacagacttcatccgccccgttctgtttctcttgattcaacccccctccatcatcccttttttctcactactcactctctctctcactctcactctcttctctctagagttcttagattcgggagatttgcattttccatctactctgtggttttcctgagctttcttgtttgccactcgatcttttttttttcttatcgagttgaaacagaaaagcgatttgatcttttcaccgtctctctctttctctttctcttctcttaaaggtacactttacgtgaatttcttatcctttgcaagtatcttttgcagatcacttgtgctttatctaccaacgaatctttcccggtgaagcaggaaaaaactgtacgcagtaaccttcacctgctttcatcaacgtcggacatcttttaactcttgctctgcgatagacatttccaccgcaaaaatggccgacggtttgcaaatgggaaacctttccctcaacgagtcccagcacgccccccagggtaacgcccctgttggccgtgccgcctacatccctccccaccttcgtcagcgtggtcccggccctgcccccagtgctaacgctggtgctccttctggcttcggtggtcctcggtacagtacacgaaagactgaacatcgtgaagcggcaactgattttgtgtcttctagtgacggtggcaactgggccaacgctaacgctcccaacttcagccctcgtggccccgcgaacggtatgaccagctggactcccgacggaaaactccgacccttcaatcccaatgcttacggaaacccaggctcttatggtggtggtagcagtggcggctacagcggtggtggtcagcaagcccgtggatcaggcgatggccagtggcgcgacggcaagcacgttcccggtcccgccaatgctcgcttggagcgcgagctgttcggagtgcccaacgacccctctaagcagcagactggaatcaacttctccaactacgatgatattcccgttgaggcctccggaaatgatgtcccggagcctgtcacccagttcaccaaccctcctctggacgatcacttgattgccaacatcaagcttgccagctatgtcattcctactcccgtccagaagtactcggttcccatcgtcatgaatggccgtgatcttatggcctgtgcccagaccggttccggaaagactggtggtttccttttccctatcctctctcaggctttccagaacggtccctctgccgcccctgtccagggcggtggtggtcagttcagctacggccgccagcgcaaggcttaccctacctctctcattcttgctcccactcgtgagctggtctctcagatcttcgaggaggcccgcaaattcgcttaccgctcgtgggtccgcccctgcgtcgtgtacggtggtgcagacatcggctcccaacttcgtcagatcgagcgtggttgcgacctcctcgttgccacccccggtcgcctggttgatctgattgagcgtggccgtatctccctggctaacatcaagtacctcgttcttgacgaggctgaccgcatgctggacatgggtttcgagccccagattcgccgcattgtcgagggtgaggacatgcccgttgttgacaatcgccaaacactcatgttctcggccaccttcccccgcgatatccaaatgcttgctcgtgatttcctcaaggactacatcttcttgtccgttggccgtgtcggaagtacttcggagaacatcacccagaaggttgagtatgtcgaggatgccgacaagcgctccgtcctgctggatattctccacacccacggcagcactggtctgaccctcattttcgttgagaccaagcgcatggccgactcgctctccgacttcctcattaaccagcgtttccctgcaactgccattcacggtgaccgtacccagcgcgagcgtgagcgtgctctcgagctcttccgtaatggtcgctgccctattctggttgctactgctgttgctgcccgtggtctcgatatccctaacgtgacccacgttatcaactacgatctccccactgacatcgacgactacgttcaccgcattggtcgtactggtcgtgccggtaacactggtatcgccactgctttcttcaaccgtggcaaccgtggtgttgttcgtgacttgctcgagcttttgaaggaagcccaccaggaggttcccgctttcctggagagcatcgcccgtgaaggtagcggattcagcggtcgtggccgtggtggtggtggccgtggccgtggtgctgctgctactcgtgacgtgcgtcgtatccccggcggcatgggcggtggctttggcggtcccggcggctacggtggctctggaggtgctgccccctcctacggtggcggctatggtgctcctgctccctcctacggtggtggttacggcggcggtggctacggcaacccctccggctcctccggcccatcttcctggtggtaaatcagtcgtggtcttttgacgatgccctcgggtctgattggctcccttgctttattttcttttgtctctcattgacggatacgatcagattgagtccctgagttcttttctacctgtgctatctctcagggacggctttgtcatgactgcacgactttcctatgcttgttttagattcatactttccccgtttgcgtatgctttaatctggttcttcctttgttgttcctctcatgtctctcttcgctgattctatccatggcctttaatattgccttgtatagatacgaggcattcgcgcagtccgatcttcttctcttgctcctaggagacgccactatctccgggcaacccgtggtcgacactgcatgaacatcatagaatgcgttgtctttgcttttttttttcctatgtccgctctcgtcagataccccttatgttcgagcgtcctcattggggatacgttcgagtgacgcgcgtgcgccgagcggagattgatgacttttcatcatctcgaaaagttctctttttctcttcgcattgatcttctcggtgttgttatggctgcattcatcatgtgcagcatagactttttacagcgtcggtatctcatggcggacatttgtttctgttgctgccctcgtgcgttctgcagtcgatttcgatttcgaaaacaaaaacgtgcgctttctttctccgggctcttttttttttcggatactggttatctcgccgctacatctcgcggcgcggctggtgtgtttcgaaaccaaaaatgggtattctttgcattctgtatggcgttggcttgacctgcaactgcatgtcttctgctttcgggtccgtggaggctgattgtctccgaataggagcatctcgcttcatttccttatctgttctgatcatttttctcggacctcgggggataggacgctgtcgccgctgaaagaatggatatacttatgaattctcgggttcggattgggagggacaaagcgaaccaacggccctaggatggccacgagaaggaaagttgtcttatccaatgcaatttcgaaaaagtgtttccaattattatggtctaggtgaagtaggtccttgtaggatgtacaacatagagtaagatataggattaatgcgtagtaaaatgtataacaccaaagatattaaactaaatgaggttcctagttattagatgaatgtcttataagatacattaatccaggtcaaaagtaccaaagtcctctagggcttatttccttggctctataaataatccaaaatgcgtggcaataatcgcatattaaacgcgtgaggtctctgatacgggtagatatcacaccagctataccttcatgggccactcggctctgctttcttcctctttttccggcttttgaacttcgtttttcccttttccctttttgcacttggcactccttttctcttttatcatttctattttcgtttgttttctcttatactatttctgcctcgttttatcggctcctagggggcactttactttataacctgcgattctcctagaatctgaccgcgaacctaccggtttcaataacccccaacatggccgatttcgaaaacagcatgatggacgagtccttcgcggcgtccgaagctgcggacgaccagtctcacggcatgaccgctagcgcgacggtcggtacaagacgacaggcgaacggcacaattggctctgtgtactccggcaacaagattcgacacctgaagaaagatgatggcatacccctatggcgcaaagatatccagtaccaattcctgaagctggtctttgaggacaagacgcccgtttttacgcggtatcccgacggacagaagggaatggacttcgccgatgtctacatcaatgcaatggcccggagcagcaagaccagcaagattctgaaggataagttacagaacgacaaacctgcggctatcaatatggctatggtctgtctgctggtcaatttcggtcgcatgaacactaccttaaactgtacgcttgcagcatatgccaaacataatttaccctctccgtgctaattgctattgtgttgttttctagtcttccccgagatgcgtgctcaactccgaacctaccactcgattccctcactacaagcgcaccaggactccaacgcctacaagcagctgcaggatgctcctcgtctcaagtccatcctcaagggcgcctcggaggatgtagaccagccgaatactttggagaagattaagcgacagaatatacctcgaaccaacccagtgaacttgatatttgtcctggcgcagtatgcccccaaagtgtcagaaacacacttctttcctccgcgagacttcttcgacctggtcatgagatctacacttagcagccaaagtcgcgctagagcgttcctttggctgatgtggtggtatctagaaagtgatttcagtcgtgaggctgctctgaataatccatttggtccaggtgcggaaggcgaggggtccgagggtcttcctctgaaagtacctccctttggcatcctgacagaggaacaagccagtgaggagaatttagatacgcccgaggaacaggagtacggggagtctaaaagactagagcgcaagcgtatgtgtttagttctgactgctgttgaagatgggacttgactgacatttggcgcaggcatcctggaagaagaggaaccactaccgcgcattcccaagcgacccaaaaaaggtgagctcgacattttgaatagttgtcatatatacgtcctcggaaacgctaaccttccccgcagaatacggctttgacgaagaatcattcgcaggagattactctggtatgggaggtcgtggctctgctatgtccacccctctccatccttctgctaaacgcagcttggatgatgaggacgatgatatgacacctggtcactcccgtccgcgccctaaacaggccaagcgggagtcatcacttaatcgagccgtgggccaacagcgactcatcttgaaaacgaggatggaacatacacctgatgcttcccccgctcctccgggtcccaatcatcccgtccttaatcgctttattacagagccctcgctttcttcagcacctactatgcgtcgaatgcggccacttacacagcaccagatagccgttgagcaaaatcgtcgacagaggattgactatctgctggccaaacgtaaatcaaacgcataccgcgttctccgtgctaaacgggagagtgagattcctttcgcgcgctacggtcgcttgcttcagggcctgcccgagggctacgatacagatgacgaagagatctcgtggggcaagggtggcctcttcccgaacccggaagaagaggatgactttggagaatgtgcaagcgtctttctctccgtagtgcgaaaagctgcccgccgacttgaccgctgggattacaccgaagccaacggccccaagaaggatcggaagagggagcgcgaagagcgataccaggccaaggcagccctagaagctgatgtgcgaaattccaacaacaaccgatcccgtccacgtcctcgccctagtgctgctgccaagcgcaagtctacgggtgtaacgggcactcctggcactaccaagaaagccgcggcgtcacaggctaagggcacacacgcccatcctgatgggttgggagctgggccatcagccgtgggtaccccaagctgggacccagagcacgggcccgaggactacatagagggggagctggacgatctcgaccgagaactccttggcgaggtttctggtgaagaagatgatggaggtgccccccgagtcgatgaagaaggggacttctctgacgatcaggatgacgaagaagatgtggacggtgatgaaaattcctcagcctatgaaggcgccaatggttacgcacgacatgaagcctcgtcccctgccccgaggggtccagctggcccacgcggggaaggttatggagacgacgcgatggaagactaatagggttggcgttttttttgctttgaaatcttgtgtatcacgatctactgtttcgtttgtcttttttttacttcctcctgttctctaggcgtattattcccttctgtaatggttgtgtttccaagtcaaattccacccaaggccttgatataagtggccagtactaccttgacctccgatatgcactgcatgtgataaacccctctttctcctctcttcatctgcccacttccatagctgcgaattgtttctttacacagataatctcaaatatcgcacacccgttcaacacacaagcttgatcatacgagttacggaagtccggtggcagagtggatacagatgctgtagagttcggtgtagccaacagtacgaagcggattcctaagacaaatttgttgagacaatctgtacttttccctctactcctcaacccgaattaacttggttttgacctgagacagatagcaggataggccttgttgcccaattgctccgaggaagtttatatttccggtaagcgtcatatcccgctaagctgcccccattctccattcttggtttctctcctttccccatatttgcacatttcgcctgacacattcccagacgcgcacaaagtatcctgtacgatatattacagctctaactacagaattgaagtcacccaaatcgtgttggacaaacaaaacacacagtttgtctttcgtcgcgaagactctctgtccccttccagagcacccaacagaaacgaggagccttggaatcaacacgcaagacaaaccagaacccgtttacccatcatgaccgaacagcctcgcatcctgcgtccgcgcccgagacgaccattcgatctgacgcctgcctccacggagtcatccggacctcccacgccggccgagtcaacaggcactgagtacctgaacccgaatgcagacgccgcgaactcaacgaatgtgagccgcacaggatcagtgatgaacctgacctcctcgacactgtacgggatctactcgccgacggcatttgacgggtttcgcgacgaatccagtccctggggtacggaagccaacagtccggcggcagagttcccgcccgagccattacagcgcgcagcagagaaatcggctatcgagccgcggcggatggcactgcggaggacccgatctcgcttgagccatggactgttccggggcgtgatcttgccgcaggcattgagcagcgtgctgctctttggctttggtcttgcttacggtgtgattacggttcatcttcatgataaccattggattacacctgtcaagctggagaatattcattactacgattcatggcagtacctaggcttctgggggttggctggtattgctctgggtaatctgcttccttggctggatagctgccgtgagggcgactctgattcgaagcttgcgggtaccaatgaggaggacagtgaggaccgcaccccatcttgggttactgttgcgcgcagtgtcggagcgtttgtcggaattgcatttgctatggtaagtggacagctgttgttttctacacttcccgttcttctctttctctatggacgatgctgacatctcgattttctttctacagcggagactcccttgggaatctaccacgcaagcatcgttgaccctcgcgctcgcgaaccccgttctctggtacctgattgaccgcaccacaactggcttcgtcctctcgaccaccgttggattggccggcatgggagtggttcttggcctcaagccagagcttgtgcccatatcgactggcccgtcattcggcaccactcttctgaatggaacaggactggagaatgtgctgggcgcaggaatcacacaggagagcattgcggtcggcacttggattgccagtgtcattttctgcgcgtgcgtgtgctttggaaatgttggccgtcagcttgccatcggagctggcgtcagagatgtcatgaagccatgagggtcgaaaagcgcctgagttttcctggttcgggatgaaagactcgagtttcgctggggaatggccttatatcagggcagggaacgtttaatgtacatctgaataatttatggctctgataaagaattgtaatagaaatcggctccgctgactttcagaaaccgtactctgtaggagattaaagaacccgtaggcctacaatatttacacaaggcgaagttctcgaggaaaaaaagttcaatgatatttattgttaaattgatcggtatgtagaatcaatcattgcaatccctactacatgaccagaggtcagcaggcactgcacccaagatcgacacctttgccagttggcacttggtctccattctctatacgatttccgtacttcatcagacaagtcttcgtaggaacgctttttgagtagaatgtgagttttgcgttgttcatgaagaagaaagaaaaaaaaggagaaatggcgcctctgagaaatctcttatgtagcctacaatcacgtgccacgctaagacctccttcataaggatggcctcctattggctggctctacagtggagcttcgagatcgatcacgtaatataacttttgctatcgaagccccgccgccgcaatcggtccgaccccgcggagtcatattttcttctttttcttcagttcgtcatctgctataccctcttcgcttggttttaggtatgtcattttgatcccttatttcaattgccggttgaatttgggaagtccttctctaaacagatctagtgtcgactgtcggatccatcatgtctcaaaagtccggtatgtcgctcttggacttcatagttccccggactatgatattatttgtcacagttcaaggtcaattctaatatccttattttggaattgaatagctatcatctccgtctatgacaagactggtctgcttgacctggccaagggtctggtcaagcaggaagtccgtcttctcgcgtctggcggtaccgctaagatgatccgtgaggctggattccctgtcgagtgagttacctctgtcatcaatggcacaattaagggagtgtcaagatcaatacacagtccaggcactgacaattaatcccagggatgtctctgccatcaccaacgcccccgagatgctcggtggccgtgtcaagaccctccaccctgccgtgcacggtggtatccttgcccgtgatatcgagtccgacgagaatgacctcgctgagcagaagatcgccaaggttgactacgtcgtctgcaacctgtaccccttcaaggagaccgtcgccaaggtcaacgtcaccatcgatgaggccgtggaggagatcgatattggcggtgtgactcttctccgtgctgcggccaagaaccacaagcgtgtgaccatcctgtcggacccccgcgattactccgatttcctcaaggagctcgaggccggcgccatcaccgatgccagccgcaagcagtacgccctcaaggctttcgagcagactgccgactacgactccgctatctcaggctttttccgcaaggagtatgctggcaacggtcagcagcagctctcgctgcgctacggtaccaacccccaccagaagcccgcctctgcctacatggtccagggccagctacctttcaaggtcctcaatggatctcctggctacgttaacctgctcgatgccctgaacgcctggcccctggtcaaggagctcaagcaggctcttggcttccccgccgctgccagcttcaagcacgtttcccccgctggtgccgctattggcgtgcccctgaacgagaaggagcgtaaggtgtacatggtggacgatatcaagggcatcgagacctccggtctggctcaggcttacgctcgtgcccgtggtgccgaccgcatgtccagcttcggtgacattctggccctcagtgacatcgtcgatgttcccaccgccaagatcatctcgcgtgaggtgtccgacggtgtcatcgccgctggctacgagcccgaggctctggacatcctctccaagaagaagggcggcaagtacctggtcctccagatggacgaggattacaccccggcccccgaggagactcgaactctgtacggtgtccagctgacccagcaccgcaacgacatcgtcatctctcccagcaagaccttcaacaccgtcatcacccccaagaacactacttcccttcccgaggctgctctccgtgacttgaccgtcgccaccattgccctcaagtacacccagtccaactccgtctgctacgccctgaacggccaaatcatcggcctgggcgccggccagcagagccgtatccactgcacccgtctggccggtgataaggccgacaactggtggatgcgcttccacgagcgcgtcatcggcatcaagtggaagcagggcaccaagcgtgctgacaagtccaacgccatcgacctgctctgctcaggccagaccccgcgcaccgacgccgagaccgccgagtacgagcgtgtcttcgaggaggtccccgctcctttcacccaggaagagcgtgaggcttggctcgagaagcttggcgaggttgctgtctcgtccgatgctttcgtaagtaatcctctttcatatatccgcccacattcactcttccgtggcaaatgctaattgtctccactagttccccttcatcgacaacgtcttccgtgccgcccgctcaggtgtcaagtacatcgccgcccccactggcagccagaacgacacccccgtcttcgagactgccgagaagctgggcatcacctttgtcgagcagggcatccgtctcttccaccactagattgttctactgggtgtcgtctttcggtgtctctttcctctctattcccctttcccttttctcgtaaaaaaacaggtgccgtctgtggtttccactgtgatggatattcgatatgatgatgatgtcaggttttctttttgaattagataaatttatacatatattttgagtacatgtgcgacatagtagttcatcctttctttttcgcaaggacttaaagtctgatcaactttaacatgttctcctcgcaattgaatcccctaatttccctgaaacgaaacgttgtcacatgggtttccccgtcggagctccgctgcaggggtactcaccaggcactcgtctcctgagataagactaaaacaccaagcaaaaccaagcaaaaccaagcaataaccaagcaatgacacaaaacattggcagaataagccccataggttgcgattatcgtcttcatatcaaccagaccttgtcaactgtgcctttggaagcgaaacgtccccgctacagatgttgatctctagtctcggacgtcgaatcccaaattgttgtctcaaatatcatgcatataccacggaatatatccaatcagacctgccaaacacaattggtgccttttccaccattgcagacgccggaaattatggttgcaatcataccactgtgattagctgtccccgcgtgtactacagagtatatattggagggaaattcccctgtcccagcagaatggccgggtatcattacagctttattgtctctcgggatgctggtacgtcaggtttgtgtcgctctggctattgtcgctcttgctggagctgtcccagcaccagtgaagcatgtcttgcacgagaagcgaagtgagcatgtggactgggtgaaaggcgagcgcattaagcgtgattccgttctgcctgtgcgtattggtcttgctcagaataatttggagaggggtgatgagtatctcatggctgtgtaagttgattttgtgtgtgtgggttcatcgtatgcgtccgatcactaatacttgtatagttccgacccggactctgccaaatatggacagtactggtctgcggaggaagtccatgaatttttcgctccttcaaaagattctgttgactctgttcgtcggtggcttcagtcctccgggatccatgagtcccggattgtacactccgataacaagggttggttggcttttgatgcctatgcacatgaagtggaggacttgttcaaggctgagttctatgaacatgagcatgccagcacttctagcatgaagattggctgcgaggagtgagtcttgttgctttctaacaactttgggcctttgactaacagcgttagatatcacgttcccgagaatatccaagcacacattgactatataactcctggagtcaagctcagtcccatcgtcaagaagaacaccaaggcaaagcggatgtcgcacttggctcattccaagggcacagtggaagccgataactctatcaaaaccacggttatatctgaaaaggcgcagtcacttcctgcggatctccagagatgcggaactgacatgactccggcctgcatcatggctttgtacgatatcccagacgccaccaaggcagcaaagggcaactcgcttggtctttacgagcagggtgactactttgccaagtcagatcttgatctctactacaaacactttgctccttggattcctcggggcacttatcccatccctgccttgattgatggagccagcttttcggtgcctgattatagcccgctgaatgctggtgaagcggatattgacattgacatggcgtaagtacaattccttttctttctagtcggatctctgtcctttgctaatgatgccagttattcgcttatctatccccagtctataactctttaccaggtcgatgaccagacttatgaaccggaagaggaaaagaccaccaatctgttcaacactttccttgacgctctcgatggtgtatgttatattcttccgaaaatcaaatgcattctgctaacgattcaagtcttactgcacatacagtgcgttcggcgaaacgggcaacaacccagatatcgatccagtctatcccaacccgcgtcctggtggctataaaggtaacataccattaccaccaaccagactaatcagatcgcttacacaaaacaggtgagcttcaatgcggtgtatacaagcccaccaccgtcatcagtgcctcctatggacaagccgaagccgatcttccaatcgcctacaccaagcgccaatgcaatgaatttatgaaactcggcctgcagggccattccatcctgttctcctctggagactacggcgtcgcctccttccacaacgacggagccgtcaacggttgtctgggacccgagggaaagatcttcaacccccaatacccctcgaactgcccctacgtgacctccgtcggaggcaccatgctctacgccgaccaaacagtcaaggatgcggagagcgtaatgtccgctaacttgggtggtgattccgcaaacttcaccagctccggcggtttctccaactacttcccgcagccttcgtaccagaagaaagccgtggagaagtacttccagaaggctaagctgacttacccgtactactctgagatggaagtcaatattaacaagacaaagggtctctacaaccgtattggtcgtggttatcctgatgtgtcggctaacggcgccgtgttccccgcttacaatggtggaaagcttacacactactacggggctagcctggcgtcacctttgttcgcttcggttctgaatttggtaagtcgaagcaaaactttgaattggtttgtttattgtgctaatggctctctttgcagatcaatgaggaacgtcttgaccagggcaaggggcctgttggttttgtgaaccccgtactttacgctcacccggaggtccttaatgatatcaccaatggaaccaatcttggatgtggctccgacggctttagtgctattccagggtgagtctgatcttctacattggctgtaggctttttactgacgtaccatgcagatgggatccggctaccggattgggcacacctaactatcccaagttgaaggagctgttcttgtctctgccttgatacaaataaggacagaggttgcaacagatttgcatacgagcgtcgatcaccttgctagatatcaatcatcaaattactctaagcccttatattgggatttcttcgtgattgtcattttcaaactgcccttcttgttatttttgattgatatctatgtctatatctaatatgagatggttttctggcgtgcttgggctagtaagtgtataatgaggtccttgagcagattgtttctccagttatctttcatctatatatgtatgttgtaaactaaggcggtaccaatcataaacggtatagggttttctacgtataaatagggataactagggactggacctaatttccttcgataaagtagactgactcccttcgtcctacagctctttacttctatctgttgggatcatcccgtgataagacaggtgtacactcactaaggcatcccatccctaagaattatacactcagtgaggtcatcaggttattgtttcatttttaggacaaagagagcaaacagaatatatatatattttcattctacctagccaggggtttttctttcgtgtctaactgactttagaagtgaagaaagcctccaactcctgcctgcattttggtcgactgcacgggttgccgcactcgttcaccaaatacagacatgtcatcatatgcatgattccagaacactagaaacagtataagttagtcctttttttcttctaataacaaagccagttagaagtcgtacagtctccaagtgttattgtgcgtgtttgtgccatagtgccccaagtatcagactagcgtcttagtccaccaggtagttagctagagccaatcgccagttttgtttgatccaattcctctcggttgtctctcagtttactcttatctattaatccgctctaatttactaccagttatgattggcttgggtcctttatggttgaaagtcgaggggaaaggtggccgccttcgaactcaacgccagggtggtccgtgcgcagggatctgtatagcttcaaatatctgtaaattagagatataaacttgcgaataggcccgtttctcgtcgccttagttatcaataggctgttaacatcatataaccatattaggcaggcaccgacgactgaattgccttcgaaaatgacattcaggcggtagcgtagaaaaggcaataaaaaagctgctgagggctcccgctcaggagctcgaccggagaaaagcatgtaaacaaaacctcgacctatctcaaccacaaacattcatgcaaatcctgaagcaccatggccatgtatccaattgaccttcctgtgagtcttatcctcgaaaattgaagctcagaagagtgattaacaagagtatacatatatagatcagcgatgctcccctcgagcgcgggatcagcccaggctcggcccccaccgacagctaccaactgttcctggcactctaccaccgcggcgagctctctctcagcgactaccgaagacgcctcggcttctccgcataccactgggccatcctcgtctgggatctcaagaacgaccgctggcacgcatacgacgtgaccgacggagcctctccagacccagtgcttcgacgcgacctcaacccggacttccaatggacctaccgcgtcaagaccaacatccatccggactcgtgtgactctctcctgatcagaatggcaatcggcgaagtccacgatggaatcggtcccgagacgatcaagatccttcttcagtctgttcagctgccgattaagggtgcttgtccgccgcagaactgcgtcaactggatcagggctgttcttcataagcttcgcttccacggctatgcccctgacctgcatgacattgagatgactattgatcgtgcgctggcttatgctgatcttcgtatggctgaccctgacaattcggcctatcttgtcgactaccttggcaatgaaatgtccttccgtacgaacatgtcttgagatgtctcgatgggatatgtcttgctgctggatcttgaagggatgtgttttgctggagtctggtgccaaggggtcatttgactatgaactgtttgttaacatggatgcgattaatggagcatgaattgattatctttgaagccatagggtggtctgtagatgttttgtattcatgttgacggtgccagacgatgtgacatggctatagatctatgactatatcacgtggcttttctatcatatgtcaatggagaagcaagtcttcacgggaacaaagaggccagagattggtcaaagcgccgatcttgccctggaatccatctcccggctttggcttgtatccgacagccgcttgctttttccattctgacgatctacacgcagcgctcattgcttgcagactgaggatgatcagagccacaatctatccattatttattagataactggctaactgggaggtacatgttagcagccaactcatcttggataggtattgaattcctgtgggcgcagccaggatccgcgacttccacgacacagactagggggaaaggcctcaaacaggatcatcatgagtcacaagctatcacaaaagtgtgatagtgaatcaacacggacgatttcatccgaccagccccgtagacatgtgccgcatagccaggaccgcaactaacctcgatctactccgtagtggagaatcagttacgagaaccggcaatgaagttccgggaccgagtcacgttcccctttttattttatttttcgcacgtgtcgatcatccgtgagcgatagcgataaaaccatgcgaataaagctagagctccaggctaacatgcattggcgttagggatgcacatcattggcataaagtgtgcacagtgcacgatccaccacacggaactcggatacggattttgactgaatttgcggatggatttaacgccgagagtcggaggaataatgtaatgttagccttgcgaggtacttttacctaaataggtatgaagcgttccaagatggtcaggtgggatggttttatccatagatgtttatgctggttattaatgtgaaatgaatagcataagctatgcatgaacatttatcagcctcagattacaccacgttgcctattttggatgaaatatgattaccaagtaattgattctcatccatgtatttcacaatctcagttcgtcatgcagtatgtggtcgttcacatcatcttgaccggctagacaattggtaatccatctataatccataattcattctagtagatctcaaacaggtctatctctcggccaacggtaacagatagcgaacggccgaagcccaagtcattgatgtcatacctgtcaagttacagtggatctcggaaaattagcaacgaaaggccgaggatccaatgtcggttattgggcgtttaataaggtggttgacaaccagccatggcgctgttggccgatgattattgtattattgtatccgatccccacagcatagaccctgaattcaattgttctggactgtggctggatctcgacctgttgactcatgatttcctgattgggttatcttcgtatcgtgttagaattgatggaagatggaagaaacattgaagattgcacgatagaacgtcttcgaatgtgcgagaaactgaaggattgaaataagccgcagagatgaaaaattgagacattccgtattcgcattctccatagggctacgaagtggagactagggtgtttcgaaacggcaagccatgcgagagcgaaccacctgcccacattttaactgcttagctcatctcggcgatatccgcaggggatcttacctaacacgccaagaaggccccggggcccaaggacatctgaaaaacaggacctcttggcttggagaaaagactgtgacgtatgccaaacacgctatcgtagtcaaggtatgcagtaaggactgtacatggtacctgtatcatgaagcgagaaacaactaatccaactcctccttgcagggcgcagtgtcaggctgtctctcactgttttgagcacatttcatgtgggcaccaatgagatctgccaatggcccaatgtgtgtcacctgtggaatgtacagcgtacaacgtcaattgtccgttgtaggcaacgctgtagaactgcgccatgagcaaatctttaagggaggaggcttatctagggatatcggaattatgctgcctcatggcctcatgaggatctgtgcatgctattcgttccccacagcactgcctactcatgcatggattcctggtcaatctctaattcctggggaatgctggtcaatcctgccaagactgggcagctgtcgtactcgttctagggagagtacaggcgaggggtagtgttgcataatactgaatacgcatacggaggctatgtggcttggcttctccaaggttccaagagcctccatgctgacaggccaattcattggttaatttggatacaacttacaacatagataggaggccgacacgttgacatgtcaaagcaattgtcagctatcatagctgttataaaagatgatgtgatttggcatgcggtgattggaaatcgaaatgctatgtaatccaaccttaggttccagggttcgataggaactttaagattgtatcagtaatcagactaaaccgttaaaggaaatggaattagggattaaggaaataaaataaataaaataaaaaagaaaatcaaaaatcaacggcaacaagtgcgaccgatactccgatcggttttttatcctccgatggattacggcacggcggattggtcatccgagtttctaagtgactcacgtatcttaattggatattttgaattgaataggagaatagtagagtagtagagtacagagtacatatgtacatatgtactattaatattgtaggcacctatataagtacctacgtatcttaggtacctagtaaagcacgacgtgtaacgtagcggtgaagatctagaaagaagggaaccttggaagcgaacagtgcattattcataattcgggctcggcgtataccctttctccatttatttccggtggatctctcatcatccgtaaagtccgtttcgggtcgatcggactaaaaaaaaaaaaatgaaaaatgaaaaatgaaaaaaacgctgccttgtcagattccaaggttagatataaacctctggtcctggaattgttatatctactttctatctcgttacactatcgatcttgtcccccttgaaaagaaaacttgatccatcttatactttcatacttttatgtataacaaagttgatctactccaaacttcttatcccttatatcacaccgccccacgacgatccactgtgactggatgacgcctaattgagtcaccaccaaaagagtcataataatccttcaaaagctcttctggcccaccatggactcttcttctatcacctctaatacctccaaaccctccccctactttgattctctcctccgtcgtcgccaacaaaagaaaatgagcattactcaaacatactacctcgcccacactgcccggaagaagctcactcgtgaagcttcccgggcagatcacgacttgcgcctgctcgttggccatgccaatctcctcgactcgctgatgtacgacctcgccgatgccgagcgtgaacaagaacgctggttcaaccagaccgtcagcggagccaccaaggcttctacttcttcctctcgtcaacacatccaatgggcttcgaccgtagtcgaagagcccgaggaggattgggatgcggaggatgcatccgatctggactccgaactcagcgacagcgacgactccgactacgacgagtcagaattcgtcatcaaccctcctccccgtcgccgcgccccatcacccgtggctcccttgcaggaggacctgctagaggaggaggacgacgacgacacagattcagactttgaatacgacgacgtggaggatctggaggagctgagcttgactcgctcaccatcgcgacagtcgccgcctgagctcctttctgattcagatggggagtccgaggacgaggcgacgccgccctccccgccccagcctacgctggaggcttttgatgaaaaggagcctgctactacggctattgccttggcgggctctgatcaaccccatctctttgagcaagggtattttggtgcacaagagcagacactcatcgaggcttattgattaagctcgatcactcatattcactttacgatcccgactatcctctacctgtctacctctctctctgccttgtgtgccatcatccagcgatatatacgtgataccctgatgcttttatgacgatatctttggagcgagtttatatttaccatctctcatcatctatttttctggcgtttttggatcggtcgcatttttcgaatatccattttggacattccattattttgatgtcatatggacatttattacatacccctctcatctctggctatccgtgatagcccaatattcagctctccctacaaaggtcgagactgcattggagtgttgaaacataggggaagacattgtgctcccaatgtactccgtacatacacgaaacaattatcttcaccccacagaaaacaatccaataaaaaattaaaatcaatactatatttccaatatttccaatatttcccactccactccatagtccagtaaatagttccattcaaaccggcagaatcgcgcatgtgaccctgtagatccccgagcgcagaatccgttcccagccaaatggaagtgcagctcgccagcacgcgatagtcttcaccgccggataagatagatagatcagagagatatgagatcatcgcggctaagtcggcatagggctagttaagagtcagctgaaggggtttactagtttcttctttagcatgtgttcggacactccgcggagagtgggttatggaaggggggggtgttttttttttttcgcttctttttgcttccaatggatgccttggctttgttcgatgtaaggtagggcgggatacatattgggctagtgaaaatcttgggggctgaggtgttttgggtatgcttgatgttgggcgatcttgacttccgttatgttattggttcggcgcttttggtttcttgcaagagatcatcccctggcattcattttccgttatctgacagtgtcagtttaccagtttacatactctgtatccgtgtccatacgagtataatcagcgtatgttgtactccgtattcagccctgaggctcctgagatatgaagttgactacgtgggtcctcttaaggtcttattgtggcttagtacggagtacatgtcgcggtagggtgcggagtatatgtactattacggagtatattactagtatccttcgaaaattgatgctatacatataactatatcattgatttggtattcctaatatcccatatagtatgttaaggttcttcctcttcaagcaaccttcgtttctgcacaatggcaaaaattatatcaatgccgtcgtagttcggactgtctagatcatcgaagcagctacattgcttggtttcaggtctcgtgaacaaatccattccttgcttcttcattagacgtaaatacatatttacttacccaagtgggaaggtaggcttccttcggtcttaacattcccatctgagtccagtacacaaagtgagacttcatatagcaaccataatgcattttaatagctttttcctcatgtggactcgacacaaatgaagctttccatatagggttgtgtcaatcaccccctgacattacataagcatagttaagctcagccgctatcgataagtgatcgccctgaaccatcctgacccctcgctgcatccgtccctctccagctcgagcaacatgcctcgtgaccatcaaccttcttagtttctattgcaacaatcctctcaaaacatgataccaaatccccgcttggtcctgtggaaccctcaacaaccccgtggccgctgatacgtactacctctcgtgctttatgtcaacacggcccacgaaaaccaacagactcattacacccctgttcattcgcatcatcgaagatcaacctcttaatgtctgcaccgacttctccaagagcctcatctgagtctgcagagcgacccgaatcaaaagatcaagatcatacgatcccacccgcggggtccggccacacccgcagcccttcgggtgaggctaagcccaaaagcaaacggagatcgatccaatttagcgtcggcgcggcagaggctcagctacccagtcgctcgttgagcttcaaggaaaagcgggtgtcatacgggggtaccccgacgagggaattattggaagaaaaggaacgggaacacaaagctaccgcattgaaccgagggccgtctccaccaccaccaaagtacgttctacttgaagattgtgtgtgaagcggcgtttattaattatataatagaacctacgagcgaggcgtctctttcgacacattcgacaactttgatgctaccgatttctccctcacattgaactacaaacacaaaggctaccagagcacacgtcgcagcaggacctttctgtgcggaaccgaccaaaacgactactccgagttcgccctcgaatggctcattgacgagctggtggatgacggggacgagatcgtctgtctgcgagcggtggagaaggactcacgcatagccagcgatgtcggaatcgaagagcgaaagtaccgcgaagaagcagaaaagctattcgagcaggtaatccagaagaacacccaggatgagaaggccatcagcttagttctggaacttgctgtgggcaaggttgagagcatcatccaacgcatggtaacatttccaagaaccccatcactatcttccaccaacctaacattcaccagatccgcatatacgagcctgcaatgctggtagtcggtacacgaggacgcaacctgaaaggagtgcacagtctgctcccgggctccgtctccaaatactgcctccagcaatcaccaatcccagtgatagtcgttcgaccctcaccaaagcgcgaaaagaagaagaaaaagcgccgagcagacccgacacggcgcagctacaaccatatcctggaaatgagcgagcagcgcggtagtcagatattcggcgccagcgccagcaacgatagcagctcctcgaagctgccagacgaagaggctgcagtcgcggaggcactcggactccccgcgtcatactcgaacgcggcctcgcgcagttctctgtcggtctctgaccgtagtagcattagccacgatgactccgactcggcttaccccattcggaactcactggatgcaatcgtcatggcgactccgagtccagcagatagctctcaggagagcgtcgttactggcgacggggctcagccatccccttcgctggatgggacggtggtctcgccatctccgtgtgaccaacccgactgccccgtctcagattcctctaccgaagttgacaacccggatgaggcaaacgaaccttccgatacaaccaagcatcccgtgtctatcccgatgattgaagtgtcagataacaatgataaaaaggacaacacgaagggatctgaatcctgaaagcatatggcttgtctggtccgcagcggcggtttaccttccatctttgcttttgctcgtgttgctccacacatacaccattgccctttctagcctactcacgatgcatacgaaccatccgatttcacacatgttctagcttctctctatcaaccagaataaacgtcgggaatcacgtcggtccgcgacgggactgatagttaaaccccagcccaataccctcatcacttattgtcctcagatatgttctgctctggttaaacattgcacatgttttggccatgtgtatctctccctcttgtgcctacagtgagaactcgctgaatgaacgcatagacattgattgcttagtctcctacagatgtgcagatctcctataacttttgtttactcgtagccattattcgcttttagtaggtacatcactacgaggatttgccaaagaagacattagaggtagccagaaggcgaagcattcattcaatcacgttaaagctgagtggtgctccgggtattgagaaaaggacaagaacagagaaaagcgaaaagcaagagagaaagagaggatatgcaaagaacgagaagggagaaagagcaaagagcaagatgaatatcagcaacccctcttcatcaccatcaatctctccatgccagtgcccacttccacagtagaaccccctactagatccgcaactgggaaaatggacgacaatatgaaatcgaagtgattcagcaagcccaattgcaaagccctactctcaaacacggctccacagcccatgtctcgattcaatgggaaaaagaaaaagaaacaataagaattgaaaaagatgtcaagattgtacactatgaatcgggtctcttcttcgaaaagaaaaagtagaaccagccgtgataaagtgaaaaaaaggaagtcctaggggataaccgaccagtcggaaaatgcaagaggactgtgaccgattaaaaacaaaggcgcgtggtgggctttcctcaagggaaaacatggaaatgacgaaaatgaagaaatctttttgtgaaccaagaaaatggaaaacgttgatcattaactcctaaggactttctatgctggggcttcgccgtccttgacagacggggtttttgagggacgacgctccgccgctgcgggctgcgacttggtgagcatcggggaagtggggtttgacggcggcgaggtggccaagttatcccgatcttcaagggcagcaagcgcgctggggagggtattagcattgggttttccgcatgaggaaagcgttgggggttgcgtacctgaaagcattcatagaagagttgtcttccttcttgctgccggtaggagtgccggtgcggctgctggaagcgctgtcgtcgctaccacggactaggctaccgccggggccgaggttcttgcggccgctgttggtgcgggagccgagaaggctggacggaccgaatgacatgggctggttggtgttgcgagtcgcacgaagacggcggagatcatcactgccaaccttgctagaggcgtagtcgggaggagggggctggtttccgtatccgaagccgcgggcgtcaccgcgacccatggggatgcggccaccgcctccgcggttgctggattggcgctggcgctcagcttcagctgcttgggcagcacgggcagcctgtttcgagagttagagatgagaaataatgaagcacagtgatcaggttactcacagcctcgcgaatctcaacgatggtttgaggacccttatcggcatccttcgagttccagcgtgcggcacgcagatcaataatatcctagaagtcatgtcagttcttttgttctcccttcacaagaccaagagctcgagagaaacttactagaagcatgaagcgaagacgactgggcaagttaggtgtctccatcatcatgtggatgcgaacgaagtaggcgtccatcatggcaggtcccttctctgaggcatcgagactggcaccgatggtgcgcagcagactggtcaaactctcgacctcggcttcatcggggacaccctcgtagtcgacaagtttcttgacacactcgtgcatgatacgctctgtaagcatgccaagcttgtacagttcaccaatgaacttgacgagaccaagaccacgacgcttagcggcggcagcgatgtagtactcatcagacatcattgcaatctgggatcgattattagtacgggagggaacatcaagttcatgtgtagatcgacatacctcttcagtagtaccctcgggcttagcaggcaggttagttttccagccacgctcgaactcttcttggcagcggttcagcaggtacttgcggaacagactgccaccagcaacaacggtgccatttctgtcacgaatattctcatccttgatttctgggctcatgctctccagcatgctcttacagaacttggcgtacataggggcccagtgagcctcatcagtagccttttcgaatgtgagttggatgacctggcgaagggtacgaccgtcggtctcgtccttggactgggagacaatcgcgaggatctgaccagagatacggtcgaagttctctggggtcatcttgttaagagcagccttgaccttgcgctgcacgacatccggtgccaagtaggcctcaccaccaggggcgggaccagcaccagcaccagcggcctgaccaacactgcgaggtttccagccagacgcggaggtttgaattgctttcaattccatgccagcggtaagaggcatcgacttgtttgccgcctcgtcctgacggccaccttgcttcttgggtcggctgtcggtacggggacccttgctcgagttgccacgaggaggaacaccggcggagtgttggcgaatgtttccaataggacccatgccaccagcaccccgtgggaatccgaagggggcggatgcattgcggctgcccatcggtccgccgcccatagggggtagctgaccaggtcggcctgtgaagttgcccatggggaaggcagtattcatggggccgctgcgagagccagcacggctgcccatgccgctaggagtgcgggcagactggggacgagaagtgtcggtgggatcaccaacggtgtcccgcagacgggcgtcccagtccacggagatcttatctttaaaggcggcctggaattgcagcaggaagttccggtcgtagtggaacttgcggccttcgggcgcagcagcgttcatagtggcgtcgggaggggtgatggaggcagggtaagtgacctttccgaggtcttccaagaatttcgcattctgcaaagacttcatgcctgcggtggcttgctggggttccgtgggcttgggagtatcaagcttgaggccagcaggtttcttgggaatagcactggcaggcttggctggcgggcccatgtcagacgaaacaggagtagcggcaccgctgtcgccaggagtggaagactcagtggcaccgtatccacccttcttgagcgcggcaaacgcgtccttggtatcgtcctggaccgcttccccaccggcacgagccttctcgcgggcaatctcgcgggcctcagcctcagcctcggccttcttcatgttcgcctcgtagttctccagttcctcgcgctccttgcgctcagcttcttccttcttagcctgctttgcgcggttgtagtcttcctcagcggcgcgctccttggcttcgatctcggccatttcgcgctcgatggcatcaaagtcgatctcatcgtcatcaacgggggcgggagccggagccggagccttcttgggctcttcagcaggggtagcagtctccttggattcttcagcagcctccaccttcttaggctcctcggccttatccttgatgctgagatcttcaattgcagcccgggcagcctcagtatcatccttcttggcatcggtcgaaacggcttcagtggtcttgcgggaggcctcatcagccagacgctgcttctgagcggcctcgtcctgctgaattttcaggcgaacagcgtccttcaattcctgcttcttctcctcgtcggtcttcgtggcattcgccttgctctcggtgcgagtgtgctcagacgcgctggcagtgcgagggggaggagtggatgtgggaggaggagtaaatttcacaggagaaggggtggcccgagcaggggacgcagggttcttttcgaaggtcttgactgagccgctgttagggtccttgatgataatcgggctcttcttggccgaaggaatgatgaagtgaggcttgggagcggggctgttagatgcgcgactgccagtgtgggtgtggctgggggcagcaggaccagtgggtgccggtccgtggccgaggctcgaacctgggcggtcagtagatacctgggagggggtacgcgaaagtggggtcgcctgaggcatggggttggggaattgctgtcccatgtactgagggttgtagggcatgccagcagcacgaggttggggcgacggtggtcccatgtagtaaccaccattcgggttgtaataaccagcgtagttgggatcgtatgcgttggggaatgactgttgaaatttaaccattgttagaaactgttcgaaatggccactttcaggcgcaagatccacggggtactcgggtgagtatggagggttgtctttgcgcctccaagagctgctaaggttcctttggggacgacgccacgaatcctgggaagaacgagaagggggggatctcacagcttgggggcccatgtgttgaccgtaaccgtaaggttgctgaggcatctgggggtgtgccatcggaacttggttcatctgaggagtggtagggttcacgttggccagcgcagggctacggttggcttggtgaggcgagttcgggtagggggccaaaggacggccctggttctggaactggggacccatgttaggaccgcctcgcggttggttgggggtctgtcggaaaccggggttgggagagtagggcatctgctgtccctggtagccgggctgagagtatccgcgaccgcgaccaccctggtagcctgagcgtccggggccgttgcccatgtggttactcatatcgctgtgggtggattgggaggactcgcgacgcaagtgctgggcaccgtgtgcaagagaagcctggatcgagcgcatctatgtgagcaaacaagttcaaaaaaaatcgagggacctggaaaagtcgcgcacaggtggtgccacgctccatacgcatctgcgcaccaagatcactcaagaaaggaaggattcgagacacttacgttggcatcaacagattccccaaaactaccgaagttcggcacatttccctgcgcctggtaagtcgatggagggggacggccgccgctggacgcgggctgggggataggcgaaggagaagtctgaggagacgtcacgcgggggttggtcgaaggggcaccaagtccagcctgggcctggttagaggcaggcacagcaggagcgcccatgttgggagaactctgctggaatccgaactgaagactgttggggcgactggccgggccaccgccgttgggcatgtagccggaggtaccgctcgaggtgatcgtcacagatggtttgcgagagtgatcggaggaagcggccgaagcagagggagctccattgacaatagtcacgccagaagaggccgcctgctgagattgattttgcatgggtttgccgttcacagatacggagctcgactgcccatgttgcgctgaaccgcccacggtgacgggtgcggcggtagagtccgtcgcggacttcttagttgcgttggcgtaagatctggctggcgcctgggtggcagccaggggggtagaggatgcgggctgggtcgaagcggcgggagtagcggtgctttgtccttggttgcccgactgaggagggttcgagctcattagacaggttgtacgtctaaacgcgcgaagagggcgatgggaaaggtaaggttcgagggaagagacaaaggtgatgtcagtacgcggaggcgtgacaaggccacatccaaacctaactgcggcttgttaaagggatgaaacgtgatggaaaaaagaggaaaactaatttccaaatacacagaagaccaggtacgcaagagcagcgttttggtcgacagtgttatgtgtttaaaagggttgtttcaaatggtagaaggttggtgggagggaaaaaattccagggaaaaaaaaatattcgggtttgtggaaaacgaaagggcagaacagagagttgcgtcccggggcgaccaacgtacctttgaatgtgttttatgggatggaatctcttgagactctctagaaagatgagatgaatgaaaattcaaaaaagtgaactgagagataaaatagtaaaaagaggtcgagagtgactatggcctacaacgccacccacatgttacaaagaaagctacatcagtacgtcgtagagtgtctataagttgtctatgagacaggctaaatgtacatcaaatgggttcgaatattaaacaatagatacccaagtacctaggtatgaccctattcgtataatatgaccgactattcctttttattcatctggaacctgatagacccagaatgttcccccaatgccccattttccccgtttgccactatagtgaccccatatatccaagatgtctacatctataccaccctatgaggtatataaggtctaccatatgtcatacctaggtagggattttcctatcttagctgcggccgcccgcttttacaacggcgctcagagccaggctcactgagtagatttcagtccgactcagtgagctgctcagatctattcacgtgactcaacaggtggtgtcctgaccatactttccccagaacccaaatgaacccatcaaactcgaagtgaccaaaataccttcacgatgagagacgagagagatatactagatctttacgcaaccgactaccaacctgtttgggctgcaggaattgaattccccggtgtcattccagaagagatatcacagtatctgtataaggatggcgagcaggtctccttgttcatcggaccgttgtcaagcctcttttggcttgagggggtggaagagctcgaagagctcattcgcgatcccgcatatgttcttacagatgagtaccgttcgatcccacagggttctccgcgtctttggattgtttcaatcttgtttgaagaagggaagataccagcaatattcatggacaagatctatgaagagcctgtccgacgccaggcttccgcgctttcttataccagctctattcccccaaatctcacaacaactcctactcaaaacaggattcaagatatcttcccctttgcgcgcctccaatcttttccgccaactatttcctgcattaagacaaaactaaagggaaagaagaacaaccgtgatgaaaattacgttgatttgatgaatacattcatcaattcacttggcggcaatcttctttacaagggcttatcacgctcgtcaacagtcagcctagcctcactcttcgcgcctctcgtctcctcaaacacgcttcagaacgggttcggacccggtttatacgctacttcctcactcaagtatgcgttggactatgcaggcccggatggggtcattttgattttcaaggatattgacttccgtccgttggttaagattgatttggccggcgaagactggcgaactacggtggactattggaccggggcgacgatttcagatgttactgagcgtgtaccagcactctgggagcgatccgatatcttgcaaggccaaatctccgtcaaagatctgaggtccaaacagagggttcccggaccagattcccaggttgtgggagtcagctatgcaggcttgaatgcatttgcatctgctttgcacatgatcatttggctagacagttcgcgctgagagaacttcgttgctttatgtcatcttgttttcaattgtctcgctaaatccgggctcttattcttatccaaggagcgggatcgtctctgtcgacccggcgtgcttgtggcttttgcttttgatattatttcctctattgctgttgcgtggaagcctatagttagctggtggactctattgctgttgcgtgaaagcctatagttagctggtggaaagataatgatattaataccaaacttccccatcttccgtccttgcagtgcatctgcgcgaactcttttatgcaaggctattcctccgaccggagggattcggcttgacatcctcggttgttttcagtattttgaactaacattttcaagttcgatttaaagtgttatttagcaaggccaaaaaaaaacccctcccctaggaacatagcagtcatcccattcccaatctctctcacccagcaagagcaaaatgttcaggttctattttggttttcttgttctactctaaaccacccctgttaaaagcggaacatctccgcgggactcaagatcggtcgtacccggttgcacgcgaccgggcaatctcatcgacagcccgtgccgcgaagtcagtaccagatgagcctgaagaatctcgctcgttgccaaaccaaccagatgcccatcccccactagtctttcgttcggggcgacgtcctagatcctcatcatcaacaacctcgaaggagttctcgctgcggttcttgcgcaacggcacgccgtaggcaaggtcatcagcctcgagcccaccccgagggctgctctgctcctcttgtgttagggttgaccggaggtgatctagcagctctcgctgcgaggaaataaagtgagccttctcggctccagacatggactgcatctggcgctgaagaagattgccactggctgaaagttcctgatcccgcgcttctcgagactttccagatgtgaccgagcccacagcggtactcagtacagaataccaatcgtttgtgttggcagacgccccaggtgctccggcggtggggatgttgaaccgcgatagtagcgactgcgcgtaggaagcggcacctggctgaggaggtgtcgtggggcgttgcgggggtagacccaagaccttctcccggatcaaatcgatagcttggtagaagtattgaagacccagtgccttggcccgctcatgagtgttgccgatcatctcttcgatctcccgctcatgatgtgtcaagaacgggtccacatagtcttggtacagtgtacgagccccttgcgtctgggggaggacgagataagccatgaaaccgaggcggatccagctgtagaatgggaacctgcatagttatcgagtcatgattagcttgcgatcatgtcgagcgaagcaagttgaactataccatccgatgataaacacagtccaggattcaaccagcagaatgactgaaagcaccacccagtacatcagccatggtgcgagttgtgaggggtcagaggaacggagagccttgtaggaagcgaaaacggggaagaggatcgtgatgaccgagctataggatagatctgcgttagcttgcgggcccattctgtccgtatatgacttgaacttacgacatcaagtccgcgaagattccaaacatgatgaagcctgggtgaattggagatgtgagaagaagaaaattccctggagattttttagttcttcagtcagccccgctgatctgagacgaactccgaagttggaacaaaaaaagaggagaacaaggcaacaaagatagttcaggggtatattacgactgaaagcagaaatcaaataatagaattagtagaaatagttctccttattccttacacataaatcactccacgataactcctatattaagagacgtgaccactcgcatttccccaagaatcaacggatgtgtgctgacgtcacgcgagacacctttttgcttcagtgcattgttaatgattcagtcattcatggatttaggacatatactatatataccttggatgtatgtctcgatatctgagatctttattttaggacttatgttcaaatgttgttatgttcaatatggtagaggtacaagcccgacaaggaacactttgctaactaatgagtggcccaatcacccgagatgccttaactacctaggtagttcctctctacgtattatgacccgttcctttttctcttcccatattccctttttctctagaacacttgcttctactccatcctatacatacccatcgttaaattcgtgaatcttggttattccccgctcgttcaactcgggggacctcggaaactcaaaccatgtgtatcgcattgatctcaactgcccacccggaatactcgttgatcataatcaacaacagagatgtaggtattcccattctgaccagtggaatcccaagcttaatatatctaggaattcctccatcgtcccacatcatcgccagactggtggccagagccatcctcacatgtcctaggctcacgagacctagcccgatctacacatggcacttggatgggggtcaccaagcatgggaaggtggcagttcttaccaattatcgcgaggactcgaccagcgcagccataggggtctacagccggggtgtcatcgtcaacagctggttgatcgggtctaccgataagcgagaggataccaaggagtttgtacaaggcatcgtggccagcccagaagcaaagcaggtggggggtttcagtctggtatgtggacatatcagcgagcccttggccattgtctccaaccgttccacagacatggatcagatcacttgggtggcaacggagaagaaccaaacgcgggggcttagcaacacaagctttgatgacagaacctggccaaagattattgatggagagcagttgatggaggcggctattgacgagcatgtgcaaaagggagatggggaagacgaggatgcattgattgatcgtctgctgcaggttctcagcacggatagtctgccacgactgtcagaagagaacaatacaattgaggagtacatccgtcatctgcacaagaccatctttgtccctcgcatcggtactccaaatgatcgtgatccagctgcagagaaaatcgctgcagctcaggtagaggatgaggccgacacacccacgaacggaccccctgaccagagttatacctgtggatcgtatggaacacagagacaaaccattctcttggcacaaccggatggacgggtgcgatattttgaaagaacgctgtatgacagtgatgcgaaggctgttcccatcgggcaaggcgatcattcatttgaattcatcatcacagagtagcttcttataagcttagtgaatacacttagacctcataacttgtttcgagaacttcagaccaaaacataccacttcacgtgacaacaagtcccttgatgcatccaatcacagctcgagaaagccattgacggaataggtaggcggtagctttctgccaaatcgagaggttatattgaactttaaggatcacatctcgcccttcggggcatatggtcaaatgaaaatatacagagaagattagcatggcccctgcactaaggatgacacgctcaatcaaagagaagctacctattttttttttcttttacagaccctttgttaaaattatagggtgagcttcaaataatactcagcttctttttattacgcttctgggaagtcacgtgagcacatgccggcgttcgaatcccgtgtgacgcgaactcaatttttaaatcccaaaacggcgagtgctactctcgatagtctcatcgatgccttctcgttttgtaacaaaaattaaaaggaaagatgggttaaatgaagcattaaggattactatttcatttacggatgtccccaagaacgagctaaggtatgtacattcctaaacgttgaccactttcagagattacgggacctatgctaacttactttttttcccacccttcccggccaaaattgagcgagatacggtgcgagagatttggtggtacaattcatttctatctggtattaggtcggagtacgaaacacgttgtcgacgaatccattttatattaacctcaacatatacacctgggcaaacatcccactgatttttgctcggtcagaacgccgcccttattctaccggcactgctagaaccatggacgaaatgtttatgttagcaagaatttactgctctgtttgtggtgcctacaatcactgcaaggacgcgccacgtctaccagtcagccaattaacagttggcgaggccttgaagcttacgaccactgtggaggaacattgtcatactatgacggatatatagcaaatccctgctgctgaagacaaactaggacttgtcaacgaagccgggttcaacactcataccattctctgaacaccagccatcgagcatataaggagtacagcaacaggcaaattatgaactacccagaggtgtcgctatacacgttcgcagtcgctttccttttatggtcaagccaaagaagtctgggtaaaacgttctgatacgagctgcttctgatataaattatgtttagagtaggaagtccgctccatgatctgtctgattttcatctggctactcgtcggcatcgcatacttattccccatttgcatgtctccaaagcgcaaatcctaactgaatccagatatcctgtatatccggtctccctaacatattatcttgaagcgaacgacatcaagcttggcgatggtagcgtttacaaaacatatcgcgacttttgcatcgctgcggtggtgagcatcttcggccctatcctcagctcgtatctggttgagatccattttctcggccgccgccgctcaattactttgatggcctgggggtgctccatttgcgcgggttctttcaccgccgtcgaaactgaggtccagagcctggccctctcatgtatgatcacttctacctgaatgccatgcacgcggttatctataggtgagtcaccgtagcaaccaattttgtttgcgaaattgactttggtctagatatatccccgaaatcatgcccgataagtatagggctgtcggatgcggcctgctgatggcctatggacgtgttggttcactgacggccccgtttgtagctacgcgggcaatgtgtattcttgtgtgcctatctttgtctgttgcgggcattttgtagttattggatttgtgtcgctggctttgccctttgagcctcgggatgtttccagtagtaggtgagatggcagctgctggcttagtattgacgtcaatcacgatttgcgcatagtacatgtcgaagatccccgagaaccaagtcgtaagagtgtgaagttataatgggcaggaaatctcctgtacactgctcgtccactctccgctccactctcattcgggctataaattatgttgtatgggactaatcagaaatgtggatactaggtaatccctacctcgatttcgatattatatgagcttagctcctcggctttacaggtttgcaaaggagtttccgagttcatttggcgaatttatccggaggatccaagggtgatcaagcccaaacgccacatggtgtttcatcttgagcatttctcatttcggccactacaccaagacgggttagccaattccacaagtgtatcaggacaatttaatttaaattgcacctttcttgacggtgagacttgtctacactagcgaaatggaaactgacctgccttttacgccgtttagtaatctcatctccacagacatcaggccatggagctaagcgttgccaatctccgacagatggggccgactatggataatgtcggtcctactccgtacggagtatacagttctgatccgcccttggtcactcgtgcttgaatcagtgacttttcagaatcggaccatttatccggatacttcggtggggagatccaccgtttagaagagacatctcctgcagccctcagggttagcgtttcccggtactccgtatcgcggtcataattaagccgaatgatgttccgagtggctctatgggagatcacaaacggtgaatcgaatccactctgttgactccgtccccgtatactaagcgctattcgacgcccctcggtgcagggtatggctatataatagacggcctccgcaggtttcactcttgctttgtgcaatacattcattctctttcattcaaacttcaagactggtctcttgattttcattccttttgtcctattccgtctcattctttatcgtcaaactcgacactcactctcttttacattacacaatgaagttcacaaacattgttctggctgctagcgccgccaccgtggcctgcgcatacccccgaggaagagacgctgtccctaacaagcagagcgctgatattaagaagcgtgcaaatggattcacctggctcggtgtgagcgagtccggtgccgaattcggcgagggcaacattcccggtaccctggaaaaagactacacctggcccaagacttcccagattcagatcttgagagatgccggtatgaacatcttccgtgtgcccttcttgatggagcgcctggtgccaaccaccatgaccggcaccccggatgccacttacatggccgcccttaagtctgtacgtaatatgcctgtcgtggttattgattacctcccaaggcctaacagttccattctatagactgtcaagttcattaccgacagtggtgcctatgccgtccttgatccccacaactacggaagatagtaagcgcatcaaaaaccacaactacccacctttattggtatgatgtatgatgctaatgctccatctacagcgctggcagcatcatcagctcgacctccgatttcaaggccttctggaagaccgttgctactgagttcgccaccaacgagaaggtcatcttcgacaccagtaagccagcacccattgtcaaactcacacgatcaaaccatccactaacacctccctagacaacgagtaccacgaccttgaccagaccctcgtcttggacctgaaccaggctgccattgacgctatccgtgccgctggcgccaccagccagtacatcttcgtcgaaggcaacgcctggagcggcgcctggtcctggaccgacaacaacgacaacctgaaggccctcacggactccgaggacaaggttgtctacgagatgcaccagtacctggacggtgacagctccggaacctccgagacctgcgtcagcagcaccatcggcaaggagcgtctccagtccgccaccgcctggttgcaggaaaacaacaagaagggcttcatcggcgagttcgccggcggcgtcaacagcgactgccaggctgccgtcgacggcatgctctcctacatgaccgagaacagcgacgtctggatgggcgccgagtggtgggccgccggtccctggtggggatcttacatgtacagcttggagccaagtgacggccctgcttactcgacctacctccccatcctcgagaagtacttcgttgacggcactgcctcggccccggcttcgtcttcttcctccgcccccacctctaccaagtctgctgcccagacatcgaccaccaccgccgctgtcgacgtcaccagcacccccagcagcaacgtccaggtccccagctccgtggttgagccgtccagctcggcctccgctcccgctgagacttccgcccctgtcgcccctgttgtccctactcccaccactgtcgcccccactaccctcgtcagcgccacctccacctccactgccaagcccaatgctcaggtacctaccaacagcccctctactggaaatgttgctaagcactactaccagtgcggtggtatcaactggactggccccactgtctgtgagactggcaccacctgcgtcaagcagaacccttactactaccagtgcgttgcttaagggatgatcttggatcaaaccaaaaaggggagattttattgacagagtggcttggtgtcagcgctttctttcttgatcgactgttttcttacactattcttatacattactttcttctcgattcacttcgattatatataaattcaatttcaatgttgcaaatactgcatgtatgcatgatgggtgacgcttctttctattcttgtgtagtcatagagacggtctcctgctgtcttccccaattatcttattctgatcttcccaatagggatgtaggaactgcttgatcatgcgcgctttgctcgtagactaagaccgaaaggagaaagttgacgttcgtcttcctgtggctaggcattgcctccaattgatgaaacatccgtagatgcccagtgcctaccacatattttcgatggatgtaaaccacatctcaagtgtgaaacttatatgaaattttcccctagccagagtaagtcaagataataccaagtgtattcataactaggtaggtaaacaagtcattctcatcataattataggcatataccccttagagtaactctgccgtggaaggaaaccgtcctagccgggaaaccctagccagaaacccaaagaaccgcagaaaacacaaccatcgccaaccacccctagaaacgaagcgagaaagaaaccgtccaggaacagatcaaaagacaaccagatcatcacaaccacctcaagcatcctcagcctggtgcaagcgcacagtaacaagatcagcaggcgcactagtcaaagtaagaccataacgaatcttctgatcaggataaacattctcaatctgatcaaagcgctgcaaaagcctaacaatgacatatccagcctcagtaagcgcaaactgctgcccaatacagatccgcggcccaccgttgaacggaatatactcccatccagcgcgacgactcgtccagcgctcaggcttgaactcgtcagcgtcaggaccccacaggtccttacgacgctgcatcacatgcgtcgtgtagatcactgactggcccttgcggatgtagacggggtcctggccgtctgggccgccgccgcgcgggatggtcgtgtcgcgggctgcgttgcggcggttgaaggggacgacggggtacagacggaggacttcgttcatcacgtgctgcaggtactggcaggactttagggtggcgaaggtgatgttctgggggttggagtaggtgccgaagttggagatgatagtttcgcggagtttggtgaagacgtctggatgccgggcgagcatgagggttgtccagctaaggagggaggctgttgtgtcgcggccggcgaggaggatgttgaggagttgggagcggagctcgattgggtcgcgggtgacttcgaggagggcttccaggaagacgtaggaggatttttcgttggcgggcttcttttcggattgggaggctgcgagggcgtttgacacgactttgtcgacgaaggagtggacttgcttgtcggagaacttggtttctttgttctcggcgaggaaggcgagtttctcgaagcggcttcgctgcgcgcagacccattgggacttgtcgaagtaggtggcgaaggagtcttcggatctgttcaggccgtttagggcgcccagctggctctcgacgctttcgccgaagaggaattctgtggcggagtcgatggtcaagcggaagaagatggattggatgtctgttgcggcggtccatccgttggctgcgacgggcagagcctgcatggccttttgcacgtgctcctcttccaattccaattgactgatctgctcgcgggtgaactgaggccgaagtaggccacgggatcggctccattcctctccatcggcggtgaactataaacagtcaatacctagattggagacatgatcaataaggtatagcatgtgactcacaataccagtgcccagcagcggatgcatgctgatttgccggacagaaccaagttcgaagtccttgaactgtgtagccaggacagcctggatgttcttggggtcgatagtgaagatgtgggtgcgaccgaggttgcggatagagaatgtagtgacatagcggttctcctggttactgatgatcttgacgcgctcctcggccaactcaggtaccagtttggccttgtctgccgccagggattgtttcaggttgtcgattccaaaaggatccttgcaagggtacattggcacgctgccacagcccagactcttagctttgcgcgagtgttgccatgagttgaataccatacggatgacctgcagcacgacggctgcggccgcaaagcccaagacgaatgacagagccatggtcctggttagatagtttggattttcagagtgcggacaggaaaacaagtggttttataagaatggagcgacctcggttgcaagcataagtggggaaaaacctccgtagcatgggaatgatcgtcacaaagctaagggtcaagagccaatcgcggaagaagtggatgtcatattcgatcggctgttcggatttcacactcgatgcaatttctgcacccatctgatctcggagctgttacttggtgtgtgtttagacccgagttcgcgtcggagtgaccgtgttggattcttgaccgtcttgtgaatgttccccctttctcacttcagttcctccgaatgtaccacccgacgtgcatcgtcagaggtcggtgtgttagaataaatcaacgggttgacatcagaatgtgcacaaggataatttcataatttcataaaatttcataatttcacaatttcccgttaggcaaatatctgtaaggccagtggggaatccctgttgcattagcgttgggcttggccgaggttatgaagatgagtgatcaattaattcaattgtaatcaacttcaacctcaatcccaacctcacctctgttctctccgataatctaaagaatattactatttcatctcagactgcagacccacaatggacatgctatcctcaaggtcctacctggaactggcacaagaagcagaaatatcgatggacaccttgtccagcgaattgacccatctaagacccccaaggggagcccaaccggagatccccgaccaactgaccgacaagcaatcggccccgggtcgtcccgtacggaaaagaggccgaccgaaattagaggctaaagatgccactgccatcgaggtagatcccgatcggcccctagaaatatgttgtacatattgaccagctccacaggaacgccgtctgcagatccgacgggcacaacgcacctaccgtcttaaaaaggagaataccatccagaccctcagatctcgcgtcaatgtactagagcagacactagagaatgtatcagatctcctcggcggagcccaccgcgacgcaatcaatcaactccacgacgatccaactcttcagccaagcgtggactatctcgctcgcacacgagagctcatcctagcagaaataaacaaggccagatcgacctctgaggacgacgatgatctccaactccagaccaacagtccatcgacagacaagcccacattcggctacgaagtgtcacacacctatcccccgaagcgggaatccaacatctcctcttcatacccacaatacacccgggcccgctccccatccccactaataaaccgcatcctcccaacaacaacaatctacacatacagccaccaagaatccaacctagcccgccgcctgcacagattcagcctcgagcacacctaccgctggctaacagacccgcgcaccgatccggccctgctaagccgcgtcttcggactagtcccctgcatccacgacatggcaggcataagacgtaatttccggcgcacgctgcggtccgagatcgggagcgggctggaattcatcaagatgcctttctacacgctcggcggtgcggggaagcacttcccgcccgtggacagcgacgggagccccgtgtacccggagaacagtcggagaccggggaagatcctgcggcggatggtgcggattttgcagcggggcgggatccaggattggaatgaggattggagtggggaccgggagcctgttgtggagggagtggtggatgggcaagtgcagatgagtgaggaggagaggattcggtcgctggatcttgatggcgaatggtttgattgccgtgatgtccagggatatctggaacatcggggtcttgtgcttgatgggtctggattgaggctcggtgtcccggagagcttggttggggctttgtatggcttttcgccggatcgatcgactgtttccagtctctatgcttcttccgatgggactcctcctgttactaagatggagtcggaaccctcgacctcgtatactctggatgttgagtgtttttttgatcgtgagttgaccgtcgatgacgtttgccccttgtgtttttgtcaatatcactgacttgagcctagtactcctcgcaaacctcaggatcctcggccgcgcgccaggattccgactatgggatgtagacgccgcactgcgatcagcgatctcccgtcgtccttttggctagccgaaccacaaagactgacagacctgtccttccatggatataatgactacttcacgagccacgaccagaatgaccatctaattatattcaaagcgatcaaaacacaagaatctgaaattgaactccattactggcattgttctggggtatagcgtagaaagatccagtatagcaaaaagaaagggaagtccatcaaatcaaatcacgtcaaatcgcatcacatgaaaacccgccaatatcacacggaaagacaatgaatcccgcgcaaggttccaagaattaacctcagcaagtccgccatcaacagtgtcggcatcggcagccacagcccgatctcatcggatcgtctagcagcaaatctcacagcactcgaagcaggcgataccggcgcaactgggataagttaattttctggaattccatcgcgcgcatgaccgaatatgtgtcttcgagtcggattgggagagggaacttacactccgcagcagataccaccgccgccaccaccgcgcagctgcatttgttcttggttggcctgatgccgatagaagttaattttcgttctcgacatatgagttttatttatgggttagggtgcacataccggctgttcagtgacgacgttctggttagttgaaggggcagcggggctggtgggctgcatggtgacggtgttggcgttccagttttcagtgggctcgttggccggggtagacttgaagaagttgaagttgaacattgtggtagtagtggtagtggtagtatgtgtatatggtacaagggtggaaacagtctaaggtgtaggataagaggtatagagaacgaagaaaagtgaagaaagaggaaaacagaaaggaggaaaggacgctatatgtagttttccaatagtttcgacgatcggctggaaaataagtccaaagtcaaatgaaacaactagcgcccgacaaaagagattaaacgcttacacattccaatactcccgaggtccgtactccgtagggcttatgcaagtcagatggggtacgagtacggagtacggagtgttgctaagtttagctggacaaatcagaatgatgctgcctggtaccaggaaccacactgaggctttgcagtatagggctatattctccagttttctctataattacctgtagaactgtggctatgttcgggtattgtaggcagatagaatatgaattgcacagcctcttcagagcttgttctctatcgaaaagccaagtaggtaaaaagcaatcagcccttcagccttgtgggcagtcgccaagacctgcagggcttggcaaacagcttatgtattgcttgtattggggtaatggtattgtaacacatttcaagatgaacctcacttgcactgactgtatggtctatatcattgatattatgtatgtacatgtagacgtgcattgaaggaactcggaaatagtcaaatatccctcacagcttcgacagaatcccatccggtcgcaaaacagaaaggtaacaactttgaatttcgctgatcgttcggcacctgcttccgattagcgtcctttttctttttcttttttcttttcttttttcgcattccagaacaatggaattctcaacttacccagccaatgccatggtgatccgcagttcttggcggaggatcttaatcgccagttccacaccttcttgtccgttgtactgtatttggtcagtaaacagcataaccaacagaaggaaacacatacagccaacccccagaacgggattcttccgataaagcagaagctagcccccaaagccagagccttgaagatatccgagcctcgtcgaatacctccatccaccgcgatcgggatccgacccttggctactggggcacagacccgcagtgcatccaatgtcgacggcatgccgtccagttgccggcctccgtggttcgaaatgacgatgccgtcgatgccgtatttgatcgcgagttctatatcttcgggggtagttactgtatcatcgattgttagccgaactgtgacctgctttacttgagtcactcaacaacacaaacataccacccttaagccagatcttcagagacgtatgttgtctcaaccaaggaattgtttcttcccagtccaaactggggtctttaaaacatcagcatgttctccacaacctcacatcaacttcaaatcagctccaccgtacataccgtagtcagtgcggtccgagtgatccgccccgtgactgaggatattcggccacgacatatcatccggaatggtatactcattccggtattcgttgatgcgcttgcctagcacgggtacatcaacagataggaacagcgccttgtacccagcctctgaaaaaggatgttagccccgcccagccaatgaagccatacaaaaaaaccattcagatacgacatactctcggctcgctctaacaactgaagcgtaatcgaccgatcccgcagtacacacatctgcatcacatacggattcccagtcccctgtgcggcaacttcctcgagcggataattcgagtacgaggacagacccatggcaaggccgaattttgcagctgcccgcgaggtcgcgagctcgccatctgggtgggcaagtttcattgatgcggcgggactgaagccgaatgggagcgagacctgttatttgagtgttagggttggccactgcgttcgtttatttcgggaaagtggaaagagcaaataccttgctaccgaggaattcggcgcttgtgtcgatcttgtcgacgttgattaagacccgaggacggatcttgtagcggtcgtaggctgtttcgttctcgttgaggctagacagatgttagggaagtggggcagtcattgcgttttgatattccatacgtgattagatccatagctcctccattgtagtagtctatcgaggtcagcactgacgcaatgaaccgttgctgtgaagtgatgacactcacctcggaccatcggagccagccgactactccccattttcttcaggtcagcaatgcagcatacatctttgtgaagggtctctccgcggtgagccattgtgccgtttgcgttgggatgtgattatagaaattgtataggaaaaatggatagagtgaggcgacgatggcacagttcaaataagaaggatccccggcgacctctcctcttccgagatcattttccattgccggattgagttgcgcacaagtagctcctcgctgctatagattggtttctggggttggtttccgattgtggaagacgatcatcggagtcccttgccagactgagattccatccacgggtggatggtgtcaccttaccaaagcactatttacaacatatacaaatatagcgccagcgccggtcatacaagagcaaggatattgtgcgtggtctagccaaacatgctgggtccaagcctcgcaagaaaaggtttccacgaaaagagaatcagagttgttcatgcggctcaggatactgtgttctagatatctggggtgagcgtcgtgtcagtattgattacggccaatagcctcttaggtcttcgttctcaatggtggtaatgaagtgcacgacattatctacattaactactgggccaaatgggctgttggcggcttcatttccagccggcccaaatctgcttttttgtcccacttatgatccatggcaaacagaggggcgatcttagtcggtttggaatggaattgctgttaaaagacgaaaggaaaagagattggaagagcaggtgattccgaggagataagctgataagagatcccatatccaagattagaaggcagttccgagtgtggcggggttagctatgacttcgacgttccctttccaatatggaaatggaatcagcaagaagctcctttttagattgaatatatcagactatatgaaatggcggcatctaagcgatcaagacctcgccgatcccatgcgctgggaggatgcagcacctgcagacgccggcatgtgaaatgcgatcagaaacggcccgtgtgtcgcacctgtcgggccctagacgtgaaatgcgagggatattccgatcaggtcttgtggatgcacactgataacggcgaggagactgagagtgctcgtgggactcgccggtatctttattcgggtacgtggccctgacagtacgagacgaactggacttggtattaacccgtgtgctagagcaatccagactttctatgagcactgcgcttgggtctgatcttgtatctggatctattgatgcatcactggcagaggttgactcgagactgcgggaccctgaacgttcgctcgatggtgatattgtcattggaccctttgcggttctcgatttctctccagcgccacggaagctagaacaagaactggtgcccgaaattgaacctgtcgcgtctgatataagttctgcagcggagccgcctgagactgtggctcctgagaatctgcaagagtctaatccctctccaatacttgattcactgtctcagatcgatgacttcctccattggtctgatctattgagctttggtctagacaatacggagtttacaacaagcggcgtcttgagtatgtcgaatgatttatctttcgatatgagtcaagagatggggttgctacccgtcgactcaaatcacaacgatgatctactgcaaactttcacaacacaacaggcaccagcagagcttatttcagcggatgtagatgcattgcaggaggccccgtttctgcttaagcacttccaggatactgtggtcccacacataatggccattccctgtcgccagaaatcgccttggaagatcttgaacgtgccggcggcggtaattacatacagtgactcgacttttcttgggacagaaaaggtcagtcaggccagacttgcaaatatgtacggcttgcttgcctgctctgctattcatcttgttttgaacccttcaacaatatcgacaaagccgcctgagtattggtggaaggttgccaaccaggcatacctgcaagctaaggatcatatgcaaacgtctttgcagtcagaaacacagggtttaaagaaagcgaaatataaagaccagctgatggctgcatgcattctcatacagtacacggtgagtttcctatttggcatcgattgaatgactctgactcccacagatcatgtccggtcaacaacaacacgcccgatgtttcatgattgatgcagagcgattattacgccttcgaggactttcaaaaacccgaatatcgaaaaaggcacgacttttgcatcacgtatacacctggttaagaatcgtcggcgagagcacatttgttctacatgactacaacctctctgcctcctccctggaagcacttggttctcgatttcgattacaacacactccgaactcagaacagatgacgaacgctgagccaaaccctcggctggatgatttcctccgcctcgaaacacaaaactcggatagtgacctcaatatcgatgaacccaaggacaaaacttcaggactccacgacatacatcttcaggactcacgcagttaccctgaaacattatacaaacagatttatggcatcccagaaacctggcttggccttgtctcgcagaccacaagactagccaacgtcttggagacattccgtattgcccgcgaggcgggtcagaccatgaaccttgaagcgtgggagacactacagcgacgtagcactcgtctggaaaatatgatctgctctttcagcctgggccgaacaagagccggagtcctggagctccatgccgactcaaaaccgcacggtcatatggtggaggccttgaatgcagctctagtaattttcttttataggcgaatccggaagatccaccccgccgctctgcagggtcatgttgatagtgttattgcagcgcttcaggcgtgcagtgcaacgctgacccaagatgatcccaccggacccggaacggcgtggccgttgttcattgcaggatgtgaggcaatgtcaaccgcaagacgaggggctgttatgagcatgttagatagggcgagctcaatatgcgggtttgccgcttttggaacagccagaaatattatcactgaagtgtggcgcaagcaggacgagcatttgactgcgaaccggggtgaatcgatgccatcgtgggtcgatgttgtgaagcaaggacagatatggcccttgttttgttaacatagctggttactctcgtcttgactatatcttacgattcgtactatgcacttttatgacgcgatgaatatggtcccaatgttgtatattctataaactatgtacatggatagtacgtgtcgcattctcattccgacattcaagcattccaaatcatcaaatgaacaaatgaacaaagatctaaacagtcttaacaccagcattctgcagcaattgcttaagctccgccgtcaactccgggttgagaagagcgaaaggcttgcgcaagccaccagtgggctggccaatcaactcaacaccagtcttaacagcagcagcatagttatgcgactcaaggaacttgcaaatggggaaagccttagcccaaatctcacgaccacgcttcaaatcccccttaacagaaaccgcctcataaagctcaacggccaactcaggaataatattcgccgcaccccagacaccaccgggagcgccagcagcaagaccatagaaagtcaaagtatcccacccattaaacgaggtaatctgatccgacagagaaaagataagctccgtcagggccggcgcattaccagaggtatccttcagatacttgacaccgaccttagacagaccggcgatctcagtgggagacagggtaatacccgacgcagaaggaatattatagaagacaatgggcagaccggaggccgtgtggatttcgttgagcaactcgtgcagctgctccaggttgacagggtcgtagaaagggggcacgaccattgtggctgcggcgccggctttggcggcgtgtacggagagctcgacggcctcggcggatgagagactgcctgtgccggcgacgacggggacgcggccagcggcgaacttaacgcacagctctgttagctgcttgcgctcggcgaaggtcattgtggtgaattcgcctgtgctgccgcctggaacgagaccgtgtacgcctgctttgatcaggtgctcgatgtgtgcttgcagacggccttcatcgatggcggtcttgtcgtctgtgaagggggtgatcagggccaccatgatcccgtaaagggggtccatgttggaggttggatgtaagtataggaagtgagaggaaatatgttttggtttggaaatatggtgagtacggcggggttggaggaagtggtgatctagatatagttggtttgattatggaatctcttaccatttctatattttctagattcatgattctatatctacttcggactgtagaggagtgacttgccgtatcgggacaggcttcctatttaggatgtgtcccaccatcggattgaggcttctttctcttctgggagtttcttctattcgagttctaggttctttcaattgttctgcttcgtgaagattaaagcgataatatcgcagttgtttaggatttggaaggcttgctggcacgcatgacatgcagatcgtgctatgcagggattccgcaatagccacacagtggatcgggatgtcaccgatggcttcgcatgtggactgtgcttccgactagccaaggatatatcccgaaatgaactatctgcggggtctaaataaggccgttgaacgtcattgtatattgtgtctccgacattggtagtaccgtaactgtcaattggcgttgagcttcgaaactagtttgtcgtctttttatcagagctgtgtcaacttcgcatatgtaacatattccattattgcaataaatacgtttagccagaacctgagaggatctcgaaaatatatatccgatgacatgttagggctgagaacatggctgatcgaaaaagatcaagaaagcaccttaatccgacataagagtccggcatatctattgatcgaataattggaaataagccgatggtattaatattaggataattgagaataattccatctactccatattttgccgcagaaaatatccctaacatcgcggagagtatatcggaaggacttgcctgaaggggcttaacctcgctgggagtgatatcctatatcataccccacgcggcgtgaaggagttggtactgttcagacttctattatacccaagaacgaaatcgaaatggacctcttcgttgatatcgtcacccccaatgggcacagctacaagcagcccaccggcctcttcatcaacaacgagattgtacctgccacaggaggccagaccatcacatctcttgaccccgcgtgcgtgattatcggaatttctctgtacacctcactaactattgtctagtaccgacaagcccattgccaccgtccaagcagcgagcgccgaagatgtcgaccacgccgtgaaggctgccaaagcggccctggtccacccctcatggaagttgcttcccgcgacagagcggggccagttgatggcccgactcgccgatctcatggaggagaacagagcgctgtttgcttctattgaagcttgggataacggtatgtatggaaatcccccaaactggagacaatttacttatcgaaggcaggaaaaccctaccacgtcgcccttgacgaagatctcactgaggcaatcacaacaattcgctattacagtggctgggctgataagacctttggccaaaccatcaatacaactccccaaaagttcgcctatacaatccgccagcccattggcgtagttggacagaaattccatggaactaccccctttcaatggccacctggaagcttggccctgcacttgcatgtggaaacacagttgtcctgaagccagccgagcagacccctctcagcgctctcattctcggcaccttgatcaagaaggccgggttccctccaggtgtggtgaacatccttaatggctacgggcgcgaggctggcgccacgctcgcttcgcacccattaatcgataaggtcgctttcacagggtcaacggcgaccgcccgggagattatgaagatggccgccggcacactcaagaatatcactctcgaaacaggcggcaagtccccattgctagtttttccggatgcagatatggaccaagcagtcaagtggtcgcatggcggtatcatgtccaacaaaggcgagatctgtaccgcgacctcgcgaatcttcgtccaccgcgatatccttgaatcattcactgctagctacaaggcggcagtggagggtgcaaagatcggcgaccagtgggacgagtcggtcttccacggcccgcaggtgacacgcgcgcaatacgaccgaatcctctcctactttgaaattgccaaaaacgaaggagctactatcctcactggtggcgctccctacacgccgactgacgagaagaataagaatgggtacttcattcaaccaaccgttattgtcaatgcaacggattctatgcgcattgcccgcgaagaagtgtttggtcccgtcgtggtgatcttccccttcgacgatgaggaagaagctattcgtcgggccaacgataccacttacggcctgggtgcggctgtcttcacgcgtgatctggagagcgctcaccgcgtggctgctgagatagagtccggtatggtctggattaacagcagccaagactgtgacccgcgtattccttttggtggtgtgaagcagagtggcattggacgtgagttgggtgaggcaggtctggaggcttatagccagattaaggcggttcatgtgaacatgggcaccaggctgtaaatgggcatatgaagtacattgcacaatatgaatgtagattttggcaagctaagcatcttctttacttcttatatatagaaaggccatgttttaatgtttcaggttagcgcctgatttttcagcctcctgcttacttgtggggtgaaggcttctccttcttcccctctcttttctcctctcaagttttctgttagcttacaatactgggttactgcgcttccttttctctgtttccttcttcctgtttccttcttcctgtttcctgtcgatgacttaccagtaagcgcccagcacaaaggaggggtaagccctccagccaaagaaataaatcatgggtctcaacagtcttgtgtcaagactgaaacgccgcacacgtgcggaagatactatcagccagtcagatccaatatccgaaagcaatggcaaagcgattctctcgtcttcaacccccgaagacacagaggtcaaccttccaccgcaaaaaccagcaaccgatgggcgtgacttgtggcttgaagcatttgagaaattgcctcgcaattcgcaagaagaacttgaaaggcgaggcatgaaccgacaaggctctgagagtatggtcaatcaagtcaaaaaatttcagaaagaggccgaaacacagcgggatagaagcttcactaaagattggaaggtccaaataggaggccacgatatcccagtgagacaaacaaccctccagatcgttaactgggccgagaaaattggggacgtagccatccaatttgcgccggctcctggagctggaggggtgtgggctgtggcaagatcagtcctcgaggtcggttctctatatcggaggatacaaggcgctgcttacacagtatggaattcagggaatcgatactttcgacaaagaaaagagcgccctactttctgttgttgacaaagtggcgggtgccatcttctccggccaggtctactacgagatatacaaccccgagcggacggggagaaaggatgtcgtggatagactttacaatgcaatcgtgacgttgtatgggtgtgtgttgcagctactggtcacatcgtctgatctttcatctaacaccgccgtgcaattttgccaggctgtttttgacactgcgaagccgtctggaatgttgctagaattggaaagattggaacaagagcttgcaacagcggctggtaagtgtgaagagacggctcacgctcaccaagaagttattttcaaggactatctccaagaagctgagaagtccctcaaaagaatcactcgtcatatggaacatgtcttcctatgggtggataaccaagaacggagggaccttcttgaatggatctcggatgtccagtatggccgtcatcacgatgagattgaagaaagaagggagcctggtactggtgattggcttgttcaagatgagagattccgtgactggatggattcatccttgtccagtaccctgtggcttcgaggatctcgtgagcctgctcaatcctcgaaatcaattatttctctgacaaaagctagctggcacgggaaaatcatttctgacttcagctgtggtcaagcatatcgaggacacgaagggaccccaaatggaaggatttggctatttcttctgcaatcaagacgagaaagatcggcgggaggcactaccagtgcttcgaagcttagttcgccagttcgctgccccaaaaggcagtaccgaatcggtaaggagaagccttcaagatgcacgggaaagagcaaccaatagagcatcacaactcagctcctcggaatgctgtcgtcagctcgtggaagcattcaatctatattcaacgagtgttatcattcttgatgccttggatgaagtcttggacgatgaacttgatattttggtcgaggctcttgaggatgccattgctgagactaaagacagaggcagagtcaagctctttgttgccagccgacccgagaaaagcattggcgcgaaatatggctcaagttcaacggtcataatccaggctcaggacaacgaaaaggacattgagaaatttgtgactaaggagatggataaatttgagaagaagtatcccaactcggaacttgccgctatgaaggacactgttgtccgagctattctcgagaaatgcgacaacatgtaagaccccatgactatgacgagcgaacaagctatatactaacgaagaaaacaggttcctgtgggccgccctccaggtaaagcaaattgtacaatgcgacaccattgaatcaatcgattacgcactggaaaccctcccgaaggggctggatgggatgtatgaccaaatatatcggaaaatccaaacccgatttccgccggaacaagccatagcagaacgcacgttcaagtgggtgctgtgctctccttacccgctcacaagtgaagaactcctctccgccgctcgcatggccattgagaaagacgacataaagttggcgagttgtgtgcagcaagagttcttgctctcaatttgtgagaacttgctcatggttgacacctacggtcgatggaggtttttccacctttcagcgagggagtacctcgagaaggcccttgggatatatcaaaaagcacactcttactgtgcccaggtgtgccttctgtctcttatgcgaacatttggcccaaaaacactccgtggaagctccgaggatccattcaatgaaacacatcctttctcttaccatgctcagacttggtgggctttttacgctcatgagcagccgcagcctgaggaagatcaatctgtcattctgctaaagaaattcattggctcacccaacaaaagtagcgccttttatattcgatggttggatcacattaaaaagcacagtctttcattccaatggccatcccgggcagggccatttatgtctcatgaagacctggcaccctctacgacaccaatgtttgctatagctcagtttttattgtatgaaacgactcttcgcaaatggtgcgacagcaatgattttgacccatttcaacaaaatgaccgtggcgaagctttgctcacgatagctgccacgactaattgcatacctttgtgcgcaactcttattgcaaaaggagttcccgtcaaccagtgcaatgccaatggcaagtatggaagcgtgctcgcagccgcagccaactgcggtagactggacacggtcaaataccttgtgcaggaggcaaaagcagacgtgaatctcccaccccagagcggggattacggcagtgcactaaatgccgccgtatttaatggaagcttggatatcgtgaagtattttgcagaggaggtcccggatgtgaatcttctagttcatgtggaaatccacggcaatgtgcttgccgccgctgcctactctggtaaactggatattgtgagataccttgtggaggaagcaaacatcgaggtgaatctcccgcctggcgagggccaggttttcggtagtgtgctttgtgccgctgcctggggaactcttgacatagtgaaatatctggtggaggaggcaaaagcagttgtgaatataccgagtgcggctggcaatggccttgttgccgctgtcttgtgtgggaatctggatattgtgcgatatcttgtggaagaggcgaaagcagatgtagatcttctgcgtgatgatgagtttcttagtatggcacttgagcaccatacaaaagaggatgctgttgcggtcaggcatattctgaagttacccagtgatcaagggacaggagatgagcactaaagcactgaaataggaatcatatatcaacggtactacagggtctacatatgtacgtatgaatgtcggggggtctcgtcttatattcgcactttatcaactttatcagacacctgcactgtacttaaactgcgtatcatgtattactctacgaatggcgttcatacgtatattattgaagacccaagacagattattagctatttattacttgtcatgtatttaatatccagttcgatacccctactcggcatatattgctagcgatggacatcctgcactatgtcatctatatattcattttatggccatttcaccgtatccagaaattgttttacctgcgccagatcggctaacgatgtctgatgcatctcgtgtttggcgattgtcatcgagcggtgggttctaccgagcaatgcttgccgatgataattactcttctgagaccacaggctcgaagctttatacgtatcgtacccgcgatatgtacgtgaagctttacagcgcatgctctccgcttcaaggcaatatctgagcggggtaagcagagtcaaagtcttcaaatccactcggtggagctataggtccccgggataggtccccggggattacctgcatatgtaggtatcctacctaggaaacacagcgcagggtagacagcaggctattggtcgccgggtccgttataaatcaggtcaattatgtagagtaattcaagaaaggataaaagccggcttccttcctgaagcgactttaccaaactatccgatcgaacgggttaccaagtctctttgatgtaaactatgactgctcctgtcgaaagaagagttcgtgtcgcagcgattcaggcagagcctgtctggaatgatctgcaaggtggtgttaacaaggtgatctccctcctgggtgatgttggaaaggaaggcgccaatgttgttggattccctgaggtttttattcccggctacccgtggtaagctcttcatctccaaaaagaatgaagatggtccctaaggtggtgttaggagtattttcactgcaaccccgttggacaacgccccctttatggaggagtacttccataattcgttggctgtcgactcggacgagatgcgccgtatccaggctgcggtcaaagaaaatgggacattttgtgttcttggattcagtgaacgttaccagggctcactttacatttcccaggtcagaaacatcccggtctatagatgtcttgatctgaccaagctgactggttgaattcaataggtcttcatcaacactgatggacagattgtccaccatcggcgcaagaccaagccaacccatgtagagagagcgtactggggtaccggcgagggtgactcattgaaatgtgtcgtcgactcgccgttcggaagaattggaggactcaattgttgggagcacacacaaccgctgcttagatactatgagtatcagcaggatgtcgacattcatgttgcgtcgtggccggtcctctgggataggccggaatctgtcggctcgcggtggccctattttatcacaggtgatatgagctccaggctatctcaggtcatggcattcgaaggtacatgctttgtccttgtctgcacccaagtgatgtctgaggagaactttgacaagaacaaggtaagagacgtagaacatatccagggtactgggggaggtttctcggccatatttggcccggggggagagcctattgctaccatgccatccgataaagaaggaatcctgtacgccaatgtcgatgtcaacgacaaacttcgagctaagcaatggcttgatgttgttggacactactccagacccgacctgttgagtttgcgtgtcaacactcacccctccaagccggtattcttcgcagaggagccagagaaatagacggggagatgtatggactttttgtctgtggcaagataggagaggaaaggggaaggccaatacaacactgaatcacttgcctaacacaacatgaactcttttcccatttttttgtcttcctttcctttactgttctcttgtaaattggccccaaaaagaatggattcgaaggtcgctgtcgctagcatgagtcattatgagtatacgcggactggcctcggtgaccctcaaaaccaacaatcatgggtaattatcactctccaactatcgttcatgactcgaaattggtaagaaagaatagacatcttcatttattcctaggacactatattaagaccgtggtagacaatcatgtcctctcttcatcgaaagactaagcaaatcgccattccaaggtttccaacatcccacatattctttccagtcgaatcaaaaagaaacatgtcatcgaaatatgcgcctgcgtgggatgaggtaaatcaagtctaaccacagaataataacaaatgctgaccttgacaagttcgtccaagaaatcggaccactgctcatgacaggctccacggtcgaggacttgtatagagattccgaggtcaacatacaaaagatcatatccaaatacgaaatcccgccaccggatgattctgtcaaaaccgaagacatcaaacttaaagatgcctgggtccgagtcttcacatccccatcagcaaccggcaacgaaccagtaggcctgttcatgcacggcggtggatggatcatgggaagcgttgaccacgaagatgccgcatgccgacttatcagcaaaagcgccggcatgaaagtcgtcagtattggatacagactcgcaccaaaattcaaattcccccacggtctcaatgactgtgtcgaggcagcattgtggacactcgagaactactcgctttcatccgttgtgctcatgggaggttcggcaggcgccaaccttgcttttggtgtcgcactaagactcatcgatgccgggcttggagataaagtcagaggtatcgtggctctggttccttgcactgtgcacccggatgcagtaccggaagacaagaaggagtactttactgctcatcaggaaaacgctatccgtactgttaacacatcggctgcgatgaaatgtttcctggattcctatgctccaccacctgctgataaatatttctctgttctcctgcacccgcgcttgaaggatctgaagaaggtctatattgtggaatgtgggacggatacactgagggatgatgctcgactgatgaaaggggctctggaggaggctggtgtacccattatgtatgatgattatcccgggtatccccattatttctggtcatatccttctccggctctggcgaaggcttcggaggagtttcacacgaacatgttccgtgcgatcaaatggatcaacatggagtgaaagtactgtggacatactacattacatgagaggaatgagcaggcctcaggctgcaaggccaacacatgtcattggaagccactggctacttcgataatatatatgtgctacctcctcaaaatatccaactgagcatactctacgaataactagccgacgtctaagtctgttcggccgaagaacgctcccaaaaaagtaagcggcaaccccccgcatgtgaaagtacttagtctccggcacttcacatcctgcaattatcagccccctaaactgttagcttaacatgtcgtgcccgaattgtttcagcggtcatatccaccaagggactccccgtggggaagtcacctctctccatggcatgcaagcctacacgaccaaacctctcaacgatgtacctcaccggggcattatcatcatagtgcctgatgccttcggctgggagttcgtgaacaatcgaattctggctgacaactacgccgaaaaggggaagtacctggtttatctacccgacttcatgaacggtatgttctagtgtctcccaagacccccaagaatgactcgctaagcgtgatattagggcactcggcccctatcagtatgatgtctgcgacaaaagagttgttgaagacgagcggactgacaacctggcttatgaagccgtaagtcgtccaattaaaccaacacaccggatcacacttgtataaaaaggccactaattcgagctatagataccatctagcctcaatgctgacaagaatgctgcccttcatgtactacaatacgttcggggtatcatggccgatcgtccgggacttcttcaagtccgtgcgcgagaacgaaggtgccgaccttcctatctacggggctggtttctgctggggtggaaaacatatcgtcaatctagccgccggagcggacatggcctcgaatggaaaaccgctacttaatgctgggtttacgggccatccgagccttctcgagattcctagcgagatcgagaaaatccaaatccccgtaagctttgcgcttggggataaagatatagttctaaaagctccacacattgagcggatcaggcaagtgttcgccagcgagtccggtactggaaaaggagaagtggtggtttatgagggcgccggtcatggcttttgtgtccgggctgattttgttctggaagatgcgagcagacaggctgatgaagcggaaaaccaggcattggcctggttcggaaagtattagcagagacaaattgaagttttatatttagttcaaatgagcgaaaggatgaatcgaggacatgtaagaggccgggccaatgagagcattgtcatagccacttcaacaccgccatactgtggcagtgcgaatcaccaaaattgccaaaaacaaaaacaacaaaaatcaacaaaaatcaacaaaaaccaaaaatatctatctcccttcggtctgcccagtgaactggtccaagttccaagtggagaatatgtagtactctaggctgcaggaatctcaccgcagtccatgcagcctagtctctttttttctgccgatggtttcttcagttccccttctatactgttcttttgcttgatcatttgcattcatatatgcctcaaatttcaaacaccccagaatctttgcttcctcgctcagattctcgaaatccagcgacaacatgtagaggcataaccgcccaaggccggccctgccgccgttcattggcatctccaaatccgtcacctgcttctacccctagaaagaaggatcctcgccaagaagctatagatatggcatctttgtactgctggcagcacaaagatcaagatccttcggccaatccacatacgactgtcatcactccgtccaagacgaggacaagtatcgatacattaatggatcgactgggtgtgctcgacataaatgatccagcctcccaaaagccaaagcctccccacaaacggcggacaaatcaaagtagggccagtgaaaagcgtcgaccaaagaaaaagaccattttctgctgcttccagatcatggaagacagcggcgaggatgacaggccggccccagttcaacggcccaaaccccctcgccctacaccttctccaaatccgaaccaaaagatcaatctgccttcttcagccggaagaccacagcatgcgcaagtgccacacactcctcaaacatcccggccaactttgtcaggcacagggaagccttctacctcgcaaacacaggccttattatcgtggatcccatccacgctttccccacagacaacatccattcttatcacggaactggccaaacccatctccagcgccgacgacgaaggctatatctatatgttctgggtgacgcccccaacagctacgacaaaccggagcgccgaatccgcagtaccgcgagacatagcatcttctctactacccaacaccccaaaaagtagcaaccacctccgcccacgcacccagccacgcagcgtcagcgaagcaatccgcgcagcacaagacctcaatgccctcacttccaacccaacatcaaccaaacccggaacgctcaggctgaaaatcggacgcacgagcaatgtgcaccgtcgcctcgctgaatggagtaaacagtgctcatacgacttgaccttgatccgttattacccttatacaccatcgtcctccgcgtcttcccctgctagggtgccgccatcccacagccggaatcgggccccttctgcatcttcagtaccgggaaggaaagtcccgcacgtgcatcgtgttgaaaggcttattcatcttgagttggcggctcagcgtgtgcgagacctaggacaatgtcctgagtgtgggaaggagcatcgagaatggtttgaggtcgaggcggaaaaggagtcgctgaggagggtggatgagtgtattcgacgatgggtctcttgggccgagtcgatggcttgacactgtagcctgtttatcacctcgtacattctgtttgggtgcatatataaacgtctctatacacattcttaccagacccgacagtgagttgtttggggaaaggggattatatcgaaagtcatgtataagcgtgagcacttcgactgacgagcgggtcctttgcttgacctctaacgggggatcggaatcgggtactctcaagacgaccaatttggaccccaaatgtccactggtgtgtcttacggagagttgtccgcccatgtgcttatgccgaaatggagcgtatagcgtattgaggttgcgaccttgatgacgacctaaccatctttgacattgatactctcatccaagagcattggcaaattcacgatccgcgactaccgcttgacgaggataatgctgcctgactaacccctgtcaaatccaccgtcatgtatcagaccccgttggattgacccgtgatttatcgtaccgggaatgacgtgtggtttgcggatgtttaccagcatccccaggaggtgctggctcgcgttcgacatgactatgccgcgatgcaagccctgggacttgagtagggttggttgaaagaaggggacatcacggaagtgggaatatccgatgatggcagctcggactctggtgacgtcctgaaccgcaggaagtgaggtggatggctctgcatggacttgggtggcttttttgcggttgttttccgggggttcgtgtccacactgctttttcattaggtttttgaggcctttgtgcctccgtttccatcgctctggcaagccacccatgagggccgttgagggtcagtgggacgacagactcgattagttaaccatgagatgccaatgtgaaacactcgatctggctgaatacacagatgttgatatcagaacgaggagtgtctaccaaataagacccctatgtcgttgtgcaaatccagatagaccgtagttatagacatgggtattttgatctatttacctatttacctatcttggtatgctataccttccgctttaccagcccacggaagaagtcgaagctgttactatcactctgcaactgccacacacgtcccgtcggacgatcattccaccccaactcctcggcgagcaaaagaccaaaatcacgggtgataccctgaatgcgagcgcgagcaccggcctcctcctccagcgtgacaatctggtgcatgtgcagccagtcttcataatacatcgcctcaaagcctcgatcgaagcctgtgcgcaagaaacgagtatacaaggcttcgaaggtagtcagaatccgagccaggagcctctcgagcgtgacgggtgaagccgcagcagcgcccggggatgcgtagcgttcggcgagggtggtcaacgcggttgtcggagaggcgttggtggcattgacgccaatgcccacgacggagatgtactcgtttgacatgaaatgggagttgataagaatgccgcagattttcgtgtaccgcttttgttcggggtcatctggatctagtgcatctgtagatattcgtcattaataaaccatcgatagtaatataaacaactggcacgtacaaatatcgttcggccattttagtttgaccgggatcttctcgtagcctttggcgtagttcttgattcctctgactactgccatggcagataggtactgaaggaacacaaccggtgccgactgaatcttgtccattgggtgccgcaccacagttgaaaacatcagagaacctgctggtgagacccagacgttggatccacgcccgcgtccagcaatttgagcggtagcggtagccgtaaacccttgcggcaactgacgaagcagcttcgtgttcctgctgttctttagaggtgaccaaaaccagacttatcgaccgaagtgcttacttttcaaggattgtgttcgtgctagtcactacctctccatataagagattggagccaaatgtcgtggcctctcccttggactcggcttggtattggcggaggtgggaatagaacgcatggtggttgaagtatggagttagtttcgaagatggtatatcatcgtggaacacgagtcgcttgatgatcgcctggtaatcaattataccttcgctagactctgaggatcctgccgggagcgattcttccagttcaccaagattccatgttccagggcgttcaatgcggaacgtatcgtggtcgtccttgagacactcggtctgaccctcttgagtgaatgcagctccaagacccgacaggatatccataggaccatcagcctcgattccagacatgtgcaaagacgacaatgaaggcactgttgtcgtgtcctgcgtgacctcaagtccgagtttggacaaacaagccttcaagaagtccgtccgttccttgtcatcggcagcgagagccgccaccatgtccgcatattcaggcccgcccgccttcgggtccagattaacagccgcaaatctagtccacaagtcagtgactcattcctgtcaatttaaatccaaaacatactcaggatgaggtccggtcaagactgctgctccactaccgactttgcagtagacaacagcagccgcaccctcccctccgtcgacattcagcttttcagtgtagctcgcaaggacctctacgccttcgtctgcgaacgacagtgcatcaacgaagacaccaccgccattgtagtacgaccggaagtcggctggcgcggcgccaacgctcaaggcttccttggccacttcgagtccagcagcgcgtgcccccgcctcgctgtggtaaacgaagcccgggaatgccccgccccgacagatgcccgggtagaacgccaattcgcgatcccctactacctccattgtcttatcaccgacctcgaactcacacctcttgcatccgtagtagccaccagcacatagaccgaggtatcgtccgccattgcggacaaactgcgcgatgcgccggttccccgcaccattaagtgcgcggcagtatcccatatccgcgccgcctggcatgaccagcatggcacacgtggtcatccaaggctctttaaggagcatgtcactcgtcacagggataacggcatagtggtgggcgagcagtcggcggagggtgtagaggcagtgacggactgagtcaacggtggttccatttcctatcgagaattcgtccgtcagcaaacggctgcgctgccaggctaaatagggttagcgaaccggagtagaccaggacattaagccttttgccactgaaattggcgttgttgcccgttggcgttgccattgttgtctcgttgcaaagggaaatccgcgcgataagagatagttctccatcttccgccgaggccaaccgcccttctccaacttcctaggtttccttgttaccatacctcagctatgtcgaacaacgtggaaaagacaactgttaccccggatgatgatgagccggatgattggtgaggcctttttcacttttctggtctgtgtggtgctaactacaatggcagggacaagcggatcttcagcacaggctgccatagtaagttatactcaattcgagtcataaaagccatactaatactgttcagctgagcaggataagatgaatgactgttactacgcaaagagggactggcgcgaatgcaagaaagaggtgagctataatatccaccaaactgaacatatatcatcctatttgaagccattggagggtcattcctacaataatcatcataccagttcttcaaagcccgacgcatggaagaaatagcatataacttcgattctccgatcatactgactctgatcaacacagatggaagctttccgcgagtgctggaagcgccagggcaacgaccagcgaacacagaccaaagacgcataatgtactctacccatttataataccatgttaaaatagactctccgatcaatcccactcaatatttacgcgattattccaatatcgacagaacgaagctatcagttcatatcacgtgatcatatatattcgctcgttgcaagacctccctcccccttccattatcaacgaaacaagccacgatgtctgctcctctccgtatccggtccttgtgggcaattgaggctctccaaaatgcgacccagctttcgcgctcctcaagagcgctcaatctaacagtcagccagttctccagccccatgaccagaagaacaatcagccacaccaccaaaaaccagaacaatcaatccgcagtcaagcccacaccagaaagctccacctcaaagccctccccctcagttgcaacccctactccaacaggcgtccccgcatcccgcgtcccaggcccaacccccaaccgcgcaacaaccgaaaacatctccaaaacaggcctatcagacaaacccctcgagctcgagagcccagccgaagagagaatcgactggacgcgctccttccacggcctatccgccgaaccgttccccaaagaagcagccgatattctgctggcggagacggatccagacgaagtcgagatcaagcccgatggcatcctctacctaccggagatcaaataccgacggattctcaaccgcgcgtttggtcctggtgggtggggtcttgtgccgcggagtgagagtatcgttacgcctaagacggtgacgagggagtatgctcttgtttgtaatggacggtaagcacatttacatttcccctgccttttcacatcaatcttgcattttatctaccagtcttgatatcgatttagcctagcccgtattgggggactaaaacaggaaccctgagctgacactcttctcactagcctcgtctccgtcgcccgcggtgaacaggactacttctccccggacggcatccccaccgctacggaaggctgccggtcgaacgcgctcgtgcgttgctgcaaggatctaggcattgcgagcgagctttgggaccctcgctggatccgaaagtacaaggccaagtacacgcgcgaggtgtttgttgagcatgtggttacgaagaggaagactaaaatctggacacggaaggatgatcccgttggatatccttggaaggagagtggaagtaaataggggtagctgggttttggcttttgcctagacttcgtcaaacttgtattatatcaatttgtttcgataggtgttagacttggggaatattatctgtttctctgctcgatattttcattggagtgtttcgtggtttctgctgagcatataccacccatcagatagtctcaagggtgttatctaacaccatttctgttcccaaggcactatgtagcctgttgtctgatgttagatcgaaaggcatcattagataccgtagcatagtcaggtagtaacgagctgcaatgaaaaaggttggaggaaaaaaaaaagaaagtagatttgattttattaccctaaatatcaggaatagcatagcttcatatccgcacaacacagagggaaattttcacgacggcttaaaaacgcagagaacagaatctatcgacatatcacacataatatgaacaccccgaggagaagaaagagaaataggtagccaggaatgggtaatcaaggaggaccaggggtacagaaaaacgagaaaacgatcaagcaccatgctccccatagggagacttatcctttttcctgagcggagcagtgttgtacggcgcagcctgctgtgggggcgtcggctggggcggggggtacatagtcggcggcgagacggggtcataccggtcagagagctggtagttactggccgccgtcacggccgagatgttcgggttcgaaacttggcgatcacgtcccggtgtgttctcagcgctgtggctgccgaccgggacctgactgtaccccgtttcgtgggagtagtagccattaaaggggttggggtcgggggagcccaccatctggatggtgctctggtcttgatcatggcttgagtgaggacggggctcgtagcgggcgctgccgcgggagcctggcttgggggtctcgaggattgggacttggcttgaggatggggtcatgcctgcggggaccggggagagaggggggtttctgagggcggggtgcacatcctgctcgtggtaggagacgcgatcaccgaccttgcggtggccggttgacaggccgcgcttgatgctttcgtttccgttgtgcacgtttagctggttgccttggttggaggcgttggtagcagtgcggtggagggcgttctcgttcctatcgtagtcgtcgcggccagtatcgacagttggggagcgagcgttgagcaattcgacgatggccgcttcgcgctcagcgttggtctgggtggagccgcggtgggtgattgttcctgagcggccctcttcgtatcctgtcgactgggctgtgttctcgtagttgagtatacctccggccgcagcggcgacgcctgggtcaggcttggaggagtcggccccgccgccctgggtagatttgcggcgacctgcgccagcaccggccccggcatcatcacccctgtcatcgccatctgcggcgtcggcgccctcttccgcgggaggttcaacacctggaccgcgaacctggatcttgcggacggctaggaccaaagcacacaggaacttggatcgccgggcagcgcgaatagtctcattcgaccagttagacttgtgacggatatcaacacgcagctggagcttgtccatatcaccaacaccgtcgagctcaatgtcaatatccggctggaagtcgcggcagttatccttgtcgcgaacaaagttctccatctcctggcgcagcaattgaacctcagcgaagctagtgtcaaaggctacggggatgacaagctgttcatgcatagcattggcgcgagtgaagttgtcaacccagagactgttcagaatattgttaggcacctgcgtgatgcgggaatcggtaacactgcggaagacggtgaaaagaagtgagatacgctcaacgacgaaaggcttgtcgctgacctcaacacggtcgccgatatcgaagggatgcttgacgaagaggaaaatgcaggaaccaaggacttcttgagcggtaacggagaagacgaaactgagtgacagcagcgaggtggcaccagctgcaatgacggtaccgaatccactggtgacgaaagaaatgaagacaagaacagcaaccagtgcagcgacacacatgagcaggttgtcgagcacacggatagcctggtcgacgtcgtgcatgctgtggttcagagcctttctcatgcgtccaaactcggtgatggtcaggaccatctcgtccagactgatatctccgttgccatccctgtcaagagccatgaagcactcctcggcctcggcctcatgttcagcacccaggacctcgacgatgtcatccatgtacagagattcacggccctcgaccacaaacgacatccagatacggcgggccagcgcagccgcatggcgcttgcgctcaagggcatcgataaccatggtgtgtgtcgcagtcgggttaaacacttgtttaccggtaagctctgatgccacgtgcccaaaagcggcagtgaccttgtcgccaacacggccgacattcttgccgacctgacggatcatgcggaggggcatagcggatgaccgtttgccgccattggtgccggcctgagcgaggatggaatcaaaaatgagcgagtcctcctctttgaactcagagcagtacacggggaacatattgcgcgaagcctcgaagaggatggtgaccaagtgcacattgcgcttggagacctggatcttggcatcgaactgcttgcggtggtagctgatggagatgagctgtacaagagctttctcgaccaggtaaatgaggctgcagatgagcagcgcaaacaagatattcttgacactcttctcccacgccttgggagccgtgtcgccagatcccttcttaccaggattcaacgtcataaccggcaggaaggtcacaagggagataacaacccagatgacaagcgcaatgggggtctcgagggcgcggagaataagcgcatacttgcgggtaccggagctgacgataccgcacaagaactggaagacataaggaatgtaacgggcgaagatcttggacgcccacagactgaaccagacgatttcgatccaagtgaagaaccagtaaagatgaacaccaccaattgtggcgtaccgcgcaaccgtagcgcccacaatgatcggaatcgcgatcaaaatcgcaatgggaataacataaatcaggtaacgagtgatgagggagtaattcaggacagcttggtagacgcggcccatacgggtgatagtgccatcctcgggcgactcggcaggctttccggacaattcattaatatcggtatccgtgcgacgtctgccgccaggaccacgacgatgggggccaacgataggttccttctccgtgacctcttgggggctggtgttggtgtcccatttacgggcacccgtttgaccacgggaagtcgtctccgtcagagggatatcaatggtcacgtcgttaggattcaacatcccattgccatggtctggcatgtcgtgcagctgctcgaatcgatgagccgtcagtcgcttggtggaaagactcgagcgtcccattgcaaggagctcgaagggcagacagggcctttattgtgtcaatgcagatctgcccctaaacaagtaatttcaattgcggagggccttcgtgtctattgtggagacgcgaaaaaaacagtcccgttatagcacaccaacggttggtagctctgccgttctttcgcctccccctcgccgggtaaaccaaaaagttccgcggccaactttttttgcttcacgatcgccgcaaggctatgggtggttatgattgccaaatcagtgtgcgtggactttggtagtcgatcgtccaattgtcaatggtcaagaagtaggtggagatgtagatcggcgaattgggtgtgttactagtgagagatcgacccaaagtcgtaaatgtacatatgtacagcaaaagaatgactaaaatcaagagagtgtcaattgcaagagaggtggaagaaagaaagaaagcaaaagacttgaagaaaacgcgacgccatggacacatgcaacgggcatgccgtgtttcagcaggacccgttgggggggaacaaggcaaaaatgtgagaccgccctcttcccccctgtggaatccttccaacctcatcattcgctgtttatctcttggtctgtgtctttatattactgatcgactctagattgctccgtgctggagaccctcttcttctccatttcgccttacgctccatctcatatattaatccacgtgatcctcgaataggatcgagaacgcgaattccgacatgcaggtccgctaccaccccacaccttgacttgtctgatggtccaatgagcagctcaagtcatcgggtggcttgagatcaaaacagtctacggagtattcggttagcccgacggggaagcagaaaaaatcgctggttctagacgcatcagacgcacataataatctacaacatatgttgtatttgatttatactggagcgcagggcgtgaaaacctgctttacgccctcgagtcaacatgcatcttctccagcgcagcaacaacctgcttcctatcccaaccagcctgcaacccccgcacaataatatcctgctcactctccggcgccataccacccacccccggcggcctccgatccaaattcgtagggaaagggtaaccctccgcaacagcctgcacaaaagccctaatccccctctgttccaacgaatgcgtctcaggatcaagttcctgcccagccaaaacacccccagcagcccggaaccgctgaaccagtaaatcccaagtcgcctcaacaagcggcacagaatcaaccgtctccataggcttcccaaaagcactactaatctgcagcaaattggcaacacgtctgaaccccccatcctcaggatccatcagattcgcgccggcggcatggaaaagcgccggattaaaaaataacccatccccaaagctcaacggaagcgcaacatatctctcctgaaagaaatcccggaactcagccttccgccacgccagataccctggcttgtaggtctgactgaaaggcaggaaccgggttggtccgctaacgacaggcatatcggtatgcgcgacggcgccctgcagcgtcaggaactgcgaggtcagctgcgtcgtggccggataccgcttgcaggctacttcttcctggaagccgaggtggtagtcgcggtgggcttcttgtgcggcgccgcctgggtgcacggcgttcacttgggctgtcacgcggtaggcggggcctagccaagactcgcagactgcggctagccatgggtttgagtagtagtcgatgaaggaggatgggtcttgcagggcgtgttttgagaaggagttccagatgcggtcgtttgtgccgcctacggcgaaatggtcgcctttcttgttgtctgattgtgcggcttcgcgggcgatgatctcgttgaaggcggtgtttgtggtgtttagggttgtttcgtattttgcgggggcgtacattgaccgtagcacgtagacgcccgggcctgtgtgaaggatgtggtgccattcatcttgaaggcggttgattagatctgatgtaaggcctgcggattcgagagcggcgaggtcatagatggggatgttggatttgacttcgctagctagtgggtaggttgctgggtctgtggtttgcgaacagatgtccttgaactcggagagttggggtgtggagggggagtagagacgggatgaaactcggtgaccgttcatggtatatatcgtacttctgtatatgacatatggagaaagtatgcgtatgtcccaattgacccattcggtgaacggcttaaatatattttgcgcggaaaacaatgtccatcgggtccccgcattaaggtcggatatacggagaagtggacatcaagttgcgactcgggaaagggtttccgttttgaataaataagatcgaaaataagaatagcaaaagagttctagacctagatgggtatcacagctatcaagcagtacaggacaggtctaccgctaccactgaagcacaaaaaaagaaaagaagtcaaataaacaattcggtcctccccaaaaagcaacaggagaacaccgagcgcaagagagccttgccttgtaaaagaaagaaaaccagacaaaagcccatgcataaaataagtggcatccgtgttgtgcctgtttcataaagatccaaatattcccaacccacgcaaatctatgcttgaatttcaaaaacgtcttttttaaccaaaagcaggaggaaaggaatttcgtaacggtgcgtgactgggcactgggcacccgtggcaattcatgcattcatcatgaccgctccgaggtccgatgtcaggacagcttcggacggcgtgggttggttgtttttgttaggttcgccgaggatgagtgtgtgttcagacatcgtctcgatcagggcactcggtcttccggtgacggtgaagaggaccttcaggaggagagtagggccttgcccgttgagaccgccttgaggttggcgccgggtgtgggtgagtagcacgcggacgagttcgcggattgctccgtcagtagacgggtggtggattgcgtctaacccgtcgattataaagaccagtaatggtggggcagattgtaagagggtgtcgactagcgatagagcggctttccagctggtgagagttccgtctaattggcgaaaccgttccgcactgagatccagaacagcgtcactgtcgactacgggaggaagccagtcgattaattgccggattatactgtaagtgagggcaattaagccttgctcgtgtaggttcagctctttggtctcctggctagggagggcgcagaaatgcgagacgacgggcagtcgagcttgacgtgcgaatgaggcatagcaggctgaaattagagccaccgggtcgagggaagcggtaggctgtgtcccgcccacggctagggcctgggatcgcgaactggtggcccattgctgtagagatgcaacgatattcccctcggcgacgaccttgatgtcgggctcgtagtcgcaaatctgatcgtcactatcgaagaagtcctggaggtgcttggatgaactttgaatctcaagtcgtgcgaggcggcgtttggatcccctcgaccattcaaaagaggacgtgtctaacaaattccgtcagatgctgaatcgagctgcaaattgcatatgactttttacctatatttggagctggaggcgtagttatgcaaacaatgccactgctctgttcactgactggctgcagttgctggcgcacagaactcaatgtctctgccaataaccgatcccggccctccctataccgagtgcgctcctctgcgtcttgctggatctcccaaatcagacggcgggtgatggtattttgcgccgctatccgacggtcctttccccggcgtcctacttggctgagtcgggactcctcccaaagtgcccgggggctatacgggtcctcctccttgtcaacatccatcgccgcatgttgccacggaagattccgcgcttgcacttgtatatagaggaccagatgatgaaattcggagtacacgtcctggctgtgcatgttcaacaactggcacgtggacctccgaacataccaatccatgaattcggtcaaaaagaagaatattagagcgtaggttttcgtaatatgcggaacggcgtttgagattagggtagcatcactaggaagatctagagcatcgtgaatatttagcagggcagtagctaagccctccattacccgtgggtaatgcgacgatgcctgagctgtatgttagcgatgcgacgagatctgtgtatagatcatccacgcaccttgatcactgattggaggactccatagaataaaggggtataggccatagggtccgggagggcggaaaggagggtcgcgtgtgtgtctatagtcggaaggagtcgatcgcacaagtccatggaatcgctaaaaatccgttgtcgggggcgggacatccagaatgtcttgatatttccgagcaaggtctgcacgtcaagtaccgtctgtggccgctcctcccattggacctgatcctggggcaggaggaggctgatgaaccgtttccaggtgtgggccaactcattgcgttcgatatcaagttcggcgatggcgggcgtcctgggaaggatacggggttagagggaggcacttgacagggttcggactaggccatcatgatgggtcatcagttcccgagaggtatatggggatgcttacgacgagattggcttcccgtcaaagcggtgttgccaggctcggctcgggatggcagtctcgggcatgatccgacagaggtgatgaagacaaagcagttgcagttttcacgacatatcccaagaaggagatgttgagtctaggtctaggacaaaagtggaagcgaaggatggggaaggaagaattggactttgttgaagggtgggttttgccgctcagagagggggaaggctaaaaatgagagaaggaagagacaggcgtttctattaatacctcgggttttttcccttctatctcttctggtttcaaggtaatctagagctgtcttatctgagtttatttcactttgtctattgtctttctttttgtccttttttttttttttttccttggtttttcctttttttttttttacccacagtgatctgatcgttactaataaatgcacttcgggcctgatgagagccgaggccctactgtctcgccacaggagaattgaacctgacttgaatagaatatgataagattcttcctaggaaggtataggatatagaatatataacatataagcatattatagttgatcgcatatcagatcataccaataaagcggggactatacaactatacttaaaacattcatctccgggtgttcgcctctccagatttcattctggagagaaacgagaacttaataaggttctggtccatttcaagagctcgacccctctttctttttgcttttttttttttttttttttttttcctctctctctctatcacttgggtcaaataatatggggtgcgtcggttttaataggtatctgcgggggagcgctgatcgtggaacaataatccaagagctgaagaagtctattaaggtaaggtaaggtaaggtcagatcagcacatcaggacatggggatgatcgggttaaatgtccaggtctgggggttggaggcgccgagtggaaaaagaaaaaagagaccaagacctaagactaagaccaagacataagacagtggacggaggtccgggattttaataagtgatctaataagttaaggcaagtcgggcgagtagaacgaatacgaaaccgatgtgtggttgtccagaggaagatcgacctttaggagtacatacaacataggtaaggtaagtccagcgatgacgttgccctcatcgtacctaaggttatatagtgtggccattgacgatcacacttttccgatgatatatattgtagttaaaaagtcaagatcagaatatcaatataatacattaatacatgaattagaatagaaagaataaaaagaataagaataggaagatagtaatcaaccaatttataatattaaatgaaatacaaaatcgaaaatcctctaatctcccccatccgctttgatcccccagccctgttagggccgatcctctcccctcattttctttcccggtttcgctcttttcgctcttattgactaatgtgacccccccacattattccactccgccgtctcccgcataatggggtttcttttctttctcttgttcttgttcttctcagttcaagcaaaggtggtgtcgctaccgtcaaatactactagccaatccactgggtttcgtattgagggaagccctctgactggccagaagcttatccccttagccgagtcgtcgattaccactgcccaactcaaggtgctatatgctcccattgttccattggggcattgctgacatcttcagtcctttaatgtttctggcactgccactcaagtcgtcccaagcaattctctcgacttaaaggaatcccagatcgcttgtatatcttgcgaccaggacgagtataccggaaatatccgagttgacgagacaattgaatacgtcacttctgctcattccgcagcagccattctgctatatagcaaaacagctatcggctgcaacttcacttccgatgaccagaccgctgcaccgtctccctatatcttcacgtttacaagccaaggcggctactctgcactactccgtgccttcgatcaaccaacaactatcagcatcgtcccaatgtcgtacctctcaggcgttccaacggacggtgataccggtagcggtggtggtgacagtccaaacactggttcgtatctcgactcctctaccttggccagtccgttgactttccccagccatgatcatcctgtacagtatcacaggtatcatcaccgcactattcctgggcattatcatcacaggtgctgtccgggctcatcgccatccggagcgatatggccctcgccggattgccgggcgagtccggcaaagccgagcccgaggtatagctcgagccatgttagatactataccggtcgtcaagtttgatgacaaaaacgatgacgtggaggccgctaaaagagacgtggagatgaccacgaaccctgaagatcgcgagcactcccatgcggacgatggccacacaccggggctatcaacgccccgcgaatccgaaatgccaaccccagacgataacgagcgccccacacccacacccacagccctcggagccaggcctgagatgcctgacgcaggtaacttctcgtgtccgatttgcacagatgatttcatcaagggccaagacctacgtgtactgccctgtaaccaccaattccacatggaatgcattgatccatggttgatgaacgtgtccgggacctgtcccctttggtatgttctatttatgttgatattgatatcaaacacatcaactcctatgcacgaaccaaactaattatatcgtagccgcatcgacctcaacccaccccaagccgaaaacccagagcaaaccgaagaaaaccccgaccatcccgaccaacccgaccaaccatctgcagaaggacaagtcctgaccacggaagatgctcgccagcaagcccgtcagcaagcccgccatacgcatcgccgtctaaccaactacctccacggacctctcaatgcccgacgaatgcgcgatgccaccgttgaggagcgactcgctgcactccgacgcgtccgcgaagcaaaccaaagcgagcccgcgcccgaaggatcacaccgtggcctgactacccggctacgcgatcgcttccgcatccgaacgcgcgcccacggtgccgaggctgagactgctgacgacaatgctgcgccttctccggcggctccggcgcccgcccatctcacaccgtctactgcatgatgcgtgatccgctctttcacataacactcctttacattctgcatatattttcgatttatgattcatatgatctcaggtcctcggtcggaggctatatggctatatggcgtttttgttttcgttctatgggttttggatttcttttcttgtttatttttatggatcttgaacgagcatggcgttctttgaatggggcttggaggaaaagagactggatttctcagtgatttgtatttacttcctttctctgcatatactttttgtatatcatggatttatggtcacatattcaactcatacattcaaatgtttctctttttttgtaatgcacgtacataatcctattagaggtatagagatagagaaatatagaaataatttacatcagggagttctagactcaaggtgagattcgtcatcaatccaccctgcccaggtgttctgcagcagatgtaagttggggctgtgccaggtcagcagggagcagtaccatgggttctgcagctttatctcgattatctcttttatctctatcaaatatcttttcttgttgtgtacataaatatgtcatatgtacctaggtacatccccaggtatatatatatatatatatatatatatgtagacatatatatgaggctttattaaaactcatatcgaagcttggaggactccgtacccataatgtgttaagatcgccaggcacaagtcagtcaccatcggaccgattggctgatcgcatgtgacacaaatctggtttttatgttggagtatttgagggatatattagtagttgaatctcttgatcttcatattattacgttcacccactatatgtaggtaataattaaacattcaaccccgtcggatcgggctattatcttgctgtggggaatcggagaaagtcccccaagttcttttcgatttctccgggatcctcctcttagtcccctcacgggtgtgggggaaatggagttatggagttcatattctagaattccagtatacaacagtatacaccagtatacttctctggtagaattcaattaccattttataaacataatatagtggaattgaataaattgagattcccctgagactaaactggtcatgccatgaccttccagaagtacccacagtgcgtctttttccgtggtatgacacactgtttctcggatgtggcctgtcggagaggatgtgttggagattcccggttttattttgattttgtactcttgtggactctggactctttataactcaacgttagaacaatcactactacatatgtagtctgtaagtctgtaaatctgtaaatctgtcaataccggcatgtgaacggagaacgataaaaatacggcaaagctcttccctcggtatcttgtgcgccgaggatatacaaacgagataaatatgtaaatataagagagacagaagacattagaatatcttccgatgaccaaaaagaatgcgctgattcccccaaaacaaccccaccccctcactccatccggtgaacgcaagcaggaatatcccgtttcggtgtcagattccggggagaacttacgttgggtaacttgcggaattatctaatttatataatttcaccatgacttccactcaatccgccagagaccgtctttcttctctatcatcacacatcatgggttcctccagtccttcagtatttaccgcggccaccgtcgctgccgctcccgaagatcctttgttcggtcttatgaaggcctatcgtgaggacccctccgataagaaggttgatctgggtattggcgcctaccgcgacaacaacgcaagaccctggattctccctgtcgtcaagaaggtaatattcatatttcttctatctctatccagttatctctaacatctacatctataggccgatgacgctatccacaacgatcccaccctcaaccacgaatacctctctatcggtggtctcgccgagttcacctccgcagctcagaaactgatcgtcggcgcagacagccctgcaattcgcgaaaagcgagtgcgtacctctctactctcccatattcccacataccttccaacaaccccacccggaccaactaaccctcccactagatctgcaccctgcaaaccatctcaggcaccggcgccgtccacctaggcggcctcttcctctcgaaattccacccccaaaagcccgccatttacctctcaaacccaacatgggcaaaccacaaccaaatattctcaaacgtcggcctaaccctagccaagtacccctacttctccgccaaaaccaaaggccttgacttcaacggcatgatagccgccctcgaagccgccccccaaggctccgtaatcctcctccacgcctgcgcgcacaacccaacaggcgtcgatcccaccgaagaccaatggaagcaaatcgccgaggtgatgcgctctcgctcgcacttccccttcttcgacaccgcctaccaaggcttcgcatccggcgatctcgtccgcgattcctgggcgatccgctacttcgtcgagcaaggcttcgagctgtgcgttgcgcagtccttcgccaagaacttcggtctctacggcgagcgcacaggcgccttccacttcgtctccgctcccggtccggatgccgcgcctgcttgctcgaacatcgcgtcgcagctggctatcctccagcgatcggagatctcgaacccgcctgcttacggtgcgcgcattgctagtcgtgtgctgaacgatcctgttctttttaaggagtgggaggcggatttgcgcacgatgagtggccgcattttggagatgaggcagggtctccgggatcgtctggagaagcggggtacccctggttcgtgggatcatatcacttcccagattggcatgtttagtttcactggtctctctgaggagcaggttttgacgctgcggtctaagtggcatgtctacatggtatgttttgactcttactggtggagtagatatatgtttggaattgcggttgctaactctcttttttttcctacttgcagacgaagaacggccgcatctccatggccggcttgaacacgaataacattgactacttcgctgaggcggttgatagtgtcgttcgcgaatctgctaagttgtgatacctatctgataccccggtcttgatatagagtggaaaccctcgaagagacttggtttggcgttctatttgctttttgaatacaagttgttccatggaagttcggcctttcttatgcattaaaataacccatactctagtcttggccttggtctcgcatttctcgttcccttagatatagcctgtgactaggtgcgtctggggtgtattccaaagttacctaggtagatatcacatgcattacatgtaaatcataggtatagcaatgcggcattgggattgtggtctaacttttgttccatggtttctgtgcagtacgttggtagaatttcgcattggaggttagaatatcaattcaattggccatgctggactgtccgtcctgtcctgtcaacagtaaggcctgaggaagtacacagtaactaccacctaattgagcaaaagacctcgggagaatatgctacattccaatgaaatagacataatggtatctagtatcgtataaaaaggcttccacggaagcttctgagtcagaacatgtctagtagtatcgggactaaaacaccaaatcccataccacaagccaggtacacaacccgacagtaccccagaagacagcctgcgccgtactccgtcgctccgtagcacgcttcagctcccgatttccctgcccaacattcgtctgcgtcgtatccacgtccgagacaagctgggaaatatattcctcctgcgtagcgaggtgggagacaagcgtttcctgcaaagaggagatctccagaagagacttctcggcgtttctaagagcagcattagcatcatcctccaacaaaccaaccggaaaacccagcaacgaaaagggaagagagaaaaaaaaaaaagaaaaacctactggaccttccccaacgtatcctcataatgcctaagcatagaatcattctcctcagcaaaaagctgcaactgctccggcgaaagctgcgcttcaatccgcgccgtatccgcctcactcagaaccgccgcctcaggcgcctggaaagcatcgaatccgaccgcaggcccaactccacccccagtcctctccgacacagaaacagaccccttccgacccgcactcccagcagccttccccgcgccaaccttataaagcacgctcttctccttctcccgcaccctctcgatccgcttctcgaccatccgacgctgcacgctgaccgcgcactctagtccacgtctcaggaaccaaagcacgctctcgcggactgtcgctgttgaccgtgcgctctcctctgcgcacacatgctctgcggatttgctctcgtcggcgctggcatctagtgcgccgcctccaccggcccagcgccagaggagggcgccggcggcggagtggccgtatttcttgtggaggagggtggaggaggtttcttggcggagggattcggcggaggagaggtttgcgattgaggttgctaggtcgcggaggaggagggctgttgaggtgtcgacttcgtcgcgttcggggtctgtgaggtttgtttgtggggttgctggggtggcatttttagggttggtgtttgggtttgggttgcggcgttggggttgtgttgttgagaggtaggcgtggcggattgattgtagatatcggaggagggagttgacgtgtgagttctgtgggggattgttagggtttgtttctgctttgctggtgttggggtatgggtatgggtatgggtgtgagtgcggaggacgtggcttacgattcggtatgcctcctttaggaactcgtcggtggtttctgtgtagggttttctcgcttgggagattgatgagccttgctttgaaagcagattgttgagggtgggcgttaggtcggtcattgtgggagtggcatggtctgaaatgtgtgtgtagtgttttgctatccaactgtacacttgtcgatcaatactcaacgtcactgcgtgagtggtttatcccgcaccctgtatttgtttgtgtctggggtaaggagtacttttgtgatagagatgggatgaggaatgccaccgaatatattaaattatctctatttgctctcttgcttttcattatgcaactcattacgtttcaggtgtcgcatctacacagaattagcccaacccatctaaccatcatcacatccatccacaatggaggaagcccaagtccactatttacgagccgttcctgaaggcccaggtggtaacgatcctcttttgatcatgccagatgccaaggaaatgtcttcgtcagaaatgcgaggacttccaaggctgcctcaaagccatggccacatgaccatgaccgggttcgtctttcccacacgggccgcagaccggttctggaacccatcctatgaactacccaggtagagaagtgcgcccatgtaatgatcggaaccatgtggctgctgtcaaagctagggatggttaccgcggccaaactccacatcctgagtcggccgtgtgaaagcgaggaccgcgaaaattataggcaatacgaaccgcataaatgaggagacctgggttgaattcggcaaccaggaaagtacggtcatttagatagtgtggataacttcggggttggatcttgagagaacgacatagcacctgggttagcaatacagaatgctggcacgaacaaaatggtgaagacactggttccgatcaaaattgaaactaaatgggttgaagctggggtatcatcgtatcaagaagcttcttggctacatggaaagcaatggttgttatgtatggcgtcatcaatcataaactgcagaagtacgaattgaggcagcttcctacacatgataggtatcaggaggatactatggctgtttcgcttctaagaggctgcagaatggattagctcatgacagtggtagtgctgggacaaggaccgtcattatgagatgaacgtaaggtttagaatatgggattggggtgttcccttgatggctgtcccaaggttggattggaggcaccagaaggcactggaagaacgaagaccagaccgatactctgaatacgagactggaggtggcgagacacgtgggatgatttgttttggacatctagccagcgtctgaaagaaatctgaactgaaaacaatatcaacaacctattgcctgatttctggaccttttaaggagatagaaatatattatagaggttgagcagactaaactataagactatataactagttatgtaactaaattctgatatacctagttagcttattcttgtagtggaaaagcccgagtggcgactccctacccgtggacatatagggattaatcacatacatattactattcttgataggtcatagatacgttttttggccttggaatactctggacaaaggttaatcaagtataaacttgcaattggcgggaactatcttcttatacctgtaacgctaaatgtctaggaatcaggtttcagatataggccacacgtcaccttagtgacacaactgtgcttgcctatattgtatcagatttatttatttgtttcttaaaaggacctcactctcctctcttaagttacccaattcaacaattccatatgcacatccaaaatggcccgtctacctcaaaacatacacccagcagcatcatctactgagctgcccaccctacgctccacacccgtcaggcggtcgatcacttcatactccatgccttgccgaagtgaccccttattgtccagctttggaaataccaccgatgtcgcaaatgacgaaacccgcgactaccactaccaagtcaaagcgactctcacaaacattctcaacgacgaccgtgtgaagcacgatcccagcggaagtcgttgcctgcagaggatattgttggaaaacgaacaagacatgcggaaacagcgaagacattcactcggcgcgtgtgctgctaagcgactatctaaaatgcactagtagtacaagaatcaacgtccatgcttccctccatttccatcagggtaaacggtcattagtagattgcttcagtctctggcagacctctcacaatgttctcttatgcttagaccgggattgaaaaagaaacattagtatttctcatgcattgatcatattttcatgctaaatacgcaaaagcaagggtataaacaaaaatcatgctaatatcaacaaagaaatccaatcaccatgcatcaaatcatcgagcgctcttccacccatatctaaagcaacagtcagcaaatgcaattctgaaaggatagaaaaatggacagataaactcacctcgatcttccccatctcactcccttcccgtcgagcaacctccttcgccgaactaaccagtaaatccagatcctcctgatcaaccatggtaatcatatccccatcgtcctgcaccttcatcttcaaaggacatttgaagccgaacttttcccgaatgcgattctcgaattccgcaaactcaatcttcggcccaatcatgatatacctagtatcatcgggagcatgtactttcgtcctgaatttctgaatctcaggtctccgcggattcgcatggcgggagtatcgcgtcggagagcgagtccggcgttgttgcggcgactggctcggaccagccggcgcaccgacgagctcgaaagcgccctcgtggagcgttgttgcatcgcatgcatcgctgccatattcttcctcttcgtcgatgtattgcggtggttggtggcgggatccgcggccccagcctgtgctggctagattgcgctggcttgagtagggatcgtacgggtctgcgtggccgtagtcgggttccggtgggtaggtggttgtgtttgagtttgtgtcgctgaggtttctgcgatggctggtttgctcgcgcaggctgtttcgggtgctttcgggtgtgtatccgcgcatggtattttgtcgtgaggatgggccgcgcggctctgacgctgtgcgtgttgtgcctatccgtggtttctcggtcgatgctggttcctgtgcatagggtcgccggtctaggctggcgcctgctcggtctaggtctagacgtggtggacggactgttcggagagatgatgatcggtggtgtccggatgctgattggcttcctgagccggatgctgtgctgacggagcggtcgtctggtggtggtgttggggggaatacgttgcggttcatgggtggttcggattgttgacgggtgcggctgctgaggttttggcgcactaggttggatgaggcgaaggagactccttcgcggccttggagggcttctttatcaatgggcattggcctccattgatgatctgatgattgattgcggtccgaggcggcaactagtcgagccttgcctaggtagtcttttgtcttgagattcttgaccttggctgcgttgggacgatagaggactcccactggaattgagaagacagtatagccctgtatctggtttagcttgtatcccagcggattagtagactccacatacatcggcattctcgcgaatggcatcgtcgatcacatcgtggtccggggtaaccttttccttggctgcatactcaaggtcctgtataccagggttcatttgccggaggtagatatagcagagaccccggttgaacaggacttcgcatgaaaagaggcggaatagcagacctaactgttcatagtcgatggaagtattccctcgcagatacagcaaagtgtcattaaagttggccaacgcttcttcgaagtccccaagcaagaaattagatacgccttgctggaagtaagcgattgcgagataccggtctaggccgacagcacgttgatagcattctacctgcatcaaaatcaatcaactgtccggaagaacatctcacgggttcacttactgctttatgatgctcgcctagcgttgcatagatcactccgcagttaaacaagatcttcgacgtgtcggcaatctgatcgaagcaccgtagggactcctcaaattcttgattatcgtaggcatcaagggcttgcacccatgtttcgatttcctgttggacaatgtcagcatgcttaatgttccgagatcacaccagatatatttacttgtttgagcgacattgtctcggagttaacaacttatttgtccgagtctcctgtgcctagatgatatagattggggaaagacttcggaagtactttccatccgactctctagggcacgataatattcttcgtagatgtccgccagcttgtgggctcactttccagcgcaaagctgggaaagctcagataatataattgccaatggccaaggactcggtgtgacgaaaagacctctcataaaggggccaagaaccgatggggcggaacgagggggagacttcagaaagttgaagtcgagtaatcccatgtaatgtgatatcccgggattgacgcgaaaaggctgggtaccagttgaaatgtatttatagaatataaccccctctggagccgacgatatcagatgcgattgagaaagtaattggcttaacgtcttgacggtttggagagtggagatgaggggggcccagtaacttggaccccagaaggattgtattagcgggataaggggggaaaagaaagagaaaaaaagaaaagatgaattgtagagaaaatgaaaaataaaaaaataaaaataaaaaagcaaagaaaaagcccaaatcttagagaacacctgcagaggggctgcacggaggggcaggggggaagaggtacggagcacggagagtactgaaaaggctacttcgaccgaaaaggtgagtgatgggacaaaaataacccgctttgctgcagcaattatgcacgtcttggtcaataggatcttacagaagggttttccttctgccgagcctgtgagtgggcagattttcatcgtattgtgatggcacaactttactcggtcaatatttcaatatatgccattctgactctcctaacctctttttttttttgactttcatctctataattgaaagacccatcacataaggcgtctgcggggatttccaaggtttcccttggaactggaatgcggtctatcggggagaatccattcattggtcctcggcccccatgtcatctcaattcattccccgccacggcgcttgcagtgctttatttagagttgaacagggcccgagtgtatgttgtatggattttccaacatctcgctacgggctcatcaaaagtagattgcttggagatagttagttgctccgtacatattccttgagccatgttgctggtgctagggccgatgctcgatccacaggactatatatacacttcgtgacctttccttttccgttttagtgctcacctgtggacgacattcaacctctggcgttccatggttcaattcgagctgttacacacgcaaagtgactcgtctgctggatggaagtggatggcttggtatggactgatgctgacgtctgttagtcttcttatcttctcgccaagtccccagtggtgtacaccggtaagaagggttgatgaacgtatcaccgagtcggtccacatcaacacttcgacagtaaggaattttgttctagatcaattgatgtctatgaatatcattccaagttaaacatcaatacaatttacttacagtcacagtctataccagctggaggctgtccaagtgttcacccacggtccactatgaaaccggcccgacccgctcaccgaacaattgatacaaaccgttgacaggagaatattcttcgaggggaaggatagtgacgtcgtatcacaattgggtttggagtctatcgcagatactagcaagcatctcgcaatttcgatagctcaatcccatagccaaagagactagcgcactctagaccatgatatagcggtgaatgataggctagaatctctccgcagtccgccaacgccgcgcggggcctgcaagacggcacagctgcaatacgcacaggaaacgtcccatcatgtgagaacagagaacgcccagtaagtgtaaatccctaggctcaattgggtcgttagtgggacttgagtgacttctagtgtgattaatctataattaggtggacgagtagcgacagaatatgccactggtgcggttgacctagaatgccgagaaaatgggagttcgtttttgctttcttggacttcctataagtaaaattgtgtgggggccaatgaccaagtgaaaaaatagctagacgtgcgtcagttacaagggaagacgcgagttgaaaaagataaaaaggctcaaccttggaagtcatgaatggtcgttctgtgctgtgaacgttcctagccatcagcggcgccgttttgtagaagggtctagcatactgttaatttttacttcagttgaggagggaaacgaagaactaaacaaaagaagaaaaagttgaacaaatccagcaggggaacggcgaacatcagcctgcgacttgcggtctgaagattcaaagccgcgcaggtgaataggtagtctggaacaggtatggttcgttggcgacttaccaactaggctacctgggtctgcagttactaccgatgtatagccacttccccatgctccttcgcattatgattaccagccacttccggcaggaacatttcaacaactctgaatgagcttcgtgctgctcaagcacctcatgtgtgtctcatataattgctagatccatggaaggtctctatgcgtagatgaactctcggccgttaggccttcgttcttcagacttgattgccattggctttaatgccactagccatgcagccgacttctggctgattgtgacacagatgcatacagcaacgggtccttccaaggtttacttgactcgagaatcccatagttgatcaagcctacctaatctctcgaactaaaccagatacaccctgtcagacccacctaggcccacttgaacgttgcatattgaaccacttgtattacatgtgtaccttaactaggtaccttgcaggaatatatgcgtgctcttgactccaacagattaaacctgcgcagaggtacgatagtggccgtctaataatagcaaaggtggcgcgcagcaccttggctatttgtccaatttggtactgacgcctcggttttctaggcacctcgtcgggtcagtggacgacccatctatcgcgtactatcgtccatcaagtccgcatatttcgtcacagtccgtgcgagtaagaaggaatcagttgcaggctctcctgcaggggtatcactcaggatctgcccatagatgtgtttcagccatttccaacggtcttcacgcatatctcttccgtagtgatagaatgccctaggtcaattttgataaatattcaaaccagcatgacagcatgagctatactaagcttctacaagagagtgttttcttgcgttctgaataaagaaagtcagcgaagcatccatctaccgtatagatgtggggagcgaagtcgcttgcataaaaacaaggacagaaaatctatttatatcaggaattaacaagctaatgccggtaacgaaattacggatgtgatctccacgtgggatacggagtagtggttggtgatcgagtacccaccccggcgcttaagagcttttcttggatcagcgaaggttttcggatatagcagggataattctttggtcttgagaggggattacattgcgctaactacattagacatcgcgtaaaatctaggtgcatcgagcaaaatccaggaaggttccaaagttcggccgggaatattcccgtccgaggtcgattattcaacgctgaagacgactatagagactgatatatatagagaatactttgtttacagcttagaaaccatcttattgccctgcttgaggagaacagcggcatctccgacgagctcatcaacgatagccttggcaggcttcttctcgttgacaacggcggcaaccttgcccatcaggaaggggcgggcgttgtccaaagcatcatcgtcgacgtcatcgggcaagttctccatatcgtgctcgacggggatgatacccttagaggtgagctgcttgatctcctcgtgacggttctcctcccagttgacgatgtaagggttcttacgaacacggaggggacgaccctataccatctgttagtaaccaggacggcttaatactgacagtcagggaatacgtacagtgaatataatggtacggatgttgtcctcgaagttagaagtgcggacagcctcctggtgagcggcgggggcaccggcctcatcagacaggatgaaacgggtaccgatccagacagcggaggcgccgagcataagggcagcagcaaccgagttaccgttgaaaagaccaccagcggcgatgacctgcacgggctggccggtcagagggctcttcttgccctggaccaacttggcaacggtggggatgaggacggtggtggggacatcaccggtgtgaccacctccctcaccaccctgggcgcagatgatatcaacgccaacatccagggccttctggacgtgcttggggtggccgatcatgttcatgcagaggatgccggcaccgtggagcttgtcgacaacggccttggggggaacaccgacggcggagacgaaaagactagccttttcctggatgataatatcgacgagctcaccgagcttgcccttggtgtagtcgtagctatttgccgaaacaaaatgcgattagcacgtgcacgtgtcaacaatgggaaaagtgccgcagcgatcgagggttcttacttggtcttgcgggcactgccgccaacctgggggaggagaaggtcgacaccgaagggagcgttcttgtcgtgcaggtagctcttgagttcggcgacctgttcgcggagcatctcgggggtgtagccaacgccaccgatcacacccagacccccggcgttggtgacagcggcggcgagcttgggacccgcagccacgttcatgcctgccagcaggatggggtggttgatcttgagcagatcagtgattggggtgcggatttgttctgtacagtggtcatggttaacatcggtcttgaagccatgggcccatgtggagccatcagttaagtagaagaggatcacatgaaaataactggcagagtaaacatagggtatataggtcacttacgaggagaagccattatgaatatatgtggagtgaaggtgtaaaaagaaaacctggggaagagaaaggatggggtgcgaccaacctataaagcaaagcaacctcggtggttcacagacttgcgatgagcctcggtccacaggacttgaccgagagattagtcacgacgttaccacccgcggaggaagtgccgtaagcggggttggaatttgacacctgaggcagaaattcccacgtgtctacctaagaggactcgacttctacaacatccatggatacacagtggaggatgtcatattgttcaaattggcctctggtccctgtcatacatatactgccactcgactttattgcagccttctaaccataaataaaatgccttaatacttctgtctagcgtcgtcgctctagtctagcttagaaaagctttagagaacttcgctcctttagaatctagagtcttacttagtgattttggagaacatataccccttctagagtaccgatatcgtcctctgtatttatagtcggatagttttggttttccgccgaaatagataacattcaaggtttggtcgtcacgcaaccgtggaatcgaaacatatgatagcgactgctcttgacgctgctcttgataaattccaaagcttaacacgtccctatactcctagtatacctaatcacgggcttgccagttttggacgaattccctctttagaatacactataccggaaagaggatcggctatatgaaaaggttatacagagccttttaggttagcggagcccgaattagctaccatggctctaggatctatattaggcggcgggtagcagaagccaaaatttcaaaaggatctttgtcttcatttctatttcctccctgatacaaagtcttccaactatacaagtctcgtttaaccgtccctgaaaatgtcggaactttttgaaagccaacaattgaagacagtcccctactgcaacgaccgccctcctcaatacgacccctgccagccaagccaagatgtactcacctccgttattgagaacgtgcatacccgccggatattagtccaacgagtagacgaatggaacagaaaggctctcagcttatcagaaataactcccatcgaacctggttactttcaggctgcgaacttttgtctagagatgagtcagttctgtaccgagggggcgcagattgctacagagttggcaaatgtctataaggaacgcaccgttcgaaacatcgaactctataccgctatggaaagactcactgagagtgagtttaaccgggcctatgcttctctagggcgggatgcaaaccagcagatgcgacaccagctggctcaggaccacgaggaccacggcgactgctctagagagagtggatataattccaaacaaatagagccagctagagattgcacgtgcgattctccgtgctctcgtgaccagttcttcgagctgtcggcaaaggtggatgagatcaatgataaacttagccaaagccttcaatcccttgatacggccagtgtttcaaaggcgactcataatgctccggcaaagccacccaagagcttttggaagagaattttgaagcattcagctcagccttaaatggtaaagtgatacctggagtgatcaaattacgaccagactgccgaatattgatgtttatcttgctttctaccgacttgaacgatccatgtggatgcatgggttgcttctgtgtgcttttgagatttcaatgccatccttttctgaacttcactttcccatgagatagattttatatcgaagtcagaagtctgtaagtccaatactcagtccttcttcaaataactttttaaccctatcgtgatggtagatcaataaggatttactacaagatctaaccccggtggacaaagagtctacagtgaacagcgaaatgcaggtccaggagaaaaatcatggtgccccagggcgccggcagtatagattcagacatagtcacctccgaagaggaccagtcgaccaaaaagaataaagataaaatcgaaccaagaacaaaaaccaaaaccaaaaccaaaaagaaatcaaccaagaacaccctcccttcactctcacctccccctcacatctgcacccagttttcttccttcatctcacctcactgaggttctcggagagaagcaaaaacggtcaaaaaacccagaggaacgccacaaaacatcacctcttcgtccccaatatatatgatacttccattttcattcagctcacctcgctaaggttctcggagtgaagaaaacggtcaaaacaagagaggaacgccgtcgactgaggaccccttcatgttgagctttgtcagctgaccaactccttgcctccgtgcgcggcggtccggaaggaggtcgcgagggctgcggcgctggcggggtctagcctcataagccaggggctggcggcctcggaggcgcgcgagccgttaggctggcgggagggggaggcggggcggcgcgaggcagggagtacgtatcccggggggaccgggacgaacctgacaccctcgtcggcggcgggcagggcgatattggggccttccgcctccaccaagacgcggagggggcgactgttgtcgccttgatgacccacaatcgtcagcgtttactactacggcgtgggggtaatgataaggctcttgagccgtaacttacctgcctccctcgctcggagccagtccttagtgagggcctcttggggacttaagatggccgtagtcctgtcatccaatctatgccacgagatgtcagccaatatgtacgaagacactccaaaagagcccctaaaaaagctcccaaaagacctttcaaaagaccttccaaaagacctttaagagcttctaaaagggcttctatagggatcatagtctttaacttacgggatctcttcagtctttgcgggagcctcggccccctcctcgggctttttacccttcttcttcttcttctcgaaaaagaagaagaagataccgccgcacaggaaggtcacgacgacgaggattaccccccaaaggggtgctggcagtttggccaggttgttgatggcggagggggtagaggggacagcggagggaggaggtgtggggagcacggagggcacttgcacgagtgtgcgaaaggtcatggtaatagtgtattccataatgagaatgttgttggataaaaaagcatctagggccctgatggaaagacgatgtaccttctacccggtaggttcgtgcctaccaaatctatactatttacgtcgtaactacgtctatagcttcctatttcacgaagacagtccgctctggtcttacggtttgatctgtttgatctagatcgatagaagacctagcaatttcagtgtaggatagccttgaaagtagtagttgtatatcttttaacgcaccaaatttagcacccttctctgcaatccttgggaaatcaacgatcataattgaaattttcttggccaaaccaaatgttaaatgggagattaaagcgaccgtagtaaggttatttgacaggaaacaaaagacgaaagtggttgtgtccatcaacaactgatagggagcgaagggcaagaacaaccatggctgacctatctgctattgggaagggtgagagagaaggagaatagttcagttatggggaggagagaagcaaggcctagtatatgtttaatgcagtctcaacatcttacatatgtatcttaaacttcacaagtcccgtgatgttatcgaacccaaattcgctgcccacgattcatagaaacggctacgaaacccccgataggttaacgacaatagcaaggaactctatcgagacgctcagggcgaacaagacgaacgtcaagtcacaactacacccaaagagccgagatatgttttcttttttcaaacacattcttgtattgtgctagtgatacttgataagctcactgctgcatagtaaatattgacttctgcagaagtttatatacatatccaagagtgtgtcaacaaacccaaggcagtaatgttctgcaaatcataaagaaaaataaaaaaatcaaaattccatcggtcctgccggttttaagaagaaaagaaaaaggataacctatcccagagtaagagtgaaaccagcgctcagagagcaagagtaggtgttcacgtcatccgggagttggtaggcatccttgcagttcgcatctccagcggcacaagaaaccgacttgcagctcgagtcactgggctgaacagtgaagccagacttgacaaagtcggaagtctcgtcgagatcgatggaggacatgtcccagaacagtttctcgccatcctgggtgtattcgaactgaagaacgctatcctgggactcgctggtggagatcttgatggagataccgccaccgttggagttggtggtccagtcttcgctgtagtcacctccggtgctgagagtcttcatgctaccagggtcggacgcggtggtccacaggtagacgtcggtacccatgttgttgacgatctgaagaccgccactgccagagtcgcgggtctcaacggcgccggattctccggatcgagcggagtgggggagggcagcagcggtggcagcgagaaggccggtaaggaagacgttgaaagtcatgatggaagattgtaaattgagggagtgaatgtggtaagacaaagtagttcactggtttacagagatactaaagtgacagtaattgaggatcaacctcgaatgaatgaatgacttcaagaagagagtgacttgaaggatcaatgaatgtgtttgaagaaagaaagaaaaaggaagccatatctgcggacgtccatctttttattgcgcctggtggagtcgtccggatgaggatgaaactttgcgagaggaccaaaaggtgtgtagggtgtggataaactacaattatagatgcgggttcagtcaataaggttgtcttccgaacgcaaccagccaatcagaccatgcggctgaggtttccacaaacggtctcgaacgcttcgtcatcttcccaaggttgaacagttcgtcatcgtcttgcgagtggacttggcgttttctagaatttcgattcttaaacttcagatcaatccaatcattcaacgagtatggttcgcaaatagaacactttgtttccactccgaaacaaacccgataggaaaaagaatgggtaccctgacatcagttcttcatggctcccaagattatccatgcatccgcagctgcccggcaatataatagagacgcattttacgtcagttatctgtggcgacttttcaactgggcattgtccttttcgcctagagaaatctacaaccaaagcagctgattattaaaatgtggtgacacgacctccggatgctaactatctactaccgaagagctcggttaccttctccgcaagatatgcacttttgagttcaacgctctgatcttttgtccgacatcatatgttctatccattcaagggtccaagtcggtccatataatccaccaactcagccacctttgtggccacgatattttgtggggctatcaatttgacagtgggcgccaaaattattagccagtgcttgtttctcgttgagcctcgtttaattacattaaaagtgcaaggggttgcggagtactttgccacctggggcaagtggatatgtcggacaatacatttgagtctaagcttctcgcctttcctgcctttcctggttattccctcgtagaatgtgcctatggcgaagttcacccaaaccagggacacttgctggctgtattaaggggaaaatgcgaatgaaaatgtcaaataatgaatctttttccttcgccttctttcttcagtagcactcggtcacaggaaccaacaaatgggaagacactacgtaataacatctgcgacattttggcaacttcttgctaagcctcgtctcaaatcccttcaacgtttgcctgaaggtcctcttgtgcaatcatctggcctggctcaaaagccgtggcaaatatcttctcaaattcagtatcggagagaaggcgcactccaacaaggtcattatccaaaaccttgaactcggcttcgaatttgccactcaagagcgcagctttcagcagcgcaagtgctttgaagaggtccaggccactctgcttggtatttttgagaatcgtctcaagctcagccgctgcgtccactggattctctatccatttgacatcaggccgcgagtacttctttgccaaattcaagactttgttttgagtcaggacaatgtcgtggacgctaaccaggcggtttttcgtctcagtagcattattcaaagcaccagcaacggcttttgcaacgctcgacagactagttgagctgaaagtatgcacaccattgtcatagactggggcagtctgagtctgcagatcggttaaaaacggcatcgacatgacaaattccaagaaggggccaacagcaaagagtgtgtactcaatctgtccgctcagcgccttctctttgagatacttctggatgtctatccataaagcgttcagcggaagtgtctcggctccaggtctggtggtaagcgccccaaagtcggaagggatgaagcgtctaacgccagccttgatgctcgcatcgatgaccgacttctgtacgctaataccagatgttccgacggtagatacaatggcatcctggccccggagaacagctacaagactgtcgatagatgaataatcgacttgcacagtcttgatgctggaaggcggttcatccatagagcgagccgtgcgactcaacaccgtgacttgaaagcccg
